United States Patent 12,576,115 (BACTERIAL COMPOSITIONS FOR TREATING AND PREVENTING HALITOSIS) - sequence listing, part 27

SEQ ID NO: 47 - DNA, 4575038 bp, unidentified (residues 1-1,525,013 of 4,575,038)
  source 1..4575038: mol_type = genomic DNA; note = Lentilactobacillus buchneri
aaaaaaggggcaaccctcagctcaccgaaaacggctgctgagagttgcctctatttttgaaggtaataaaaaagaccgattaacatcgatccaagttattactatacacgggttactttacctgatttaagtgttcgggcagaaatccaaaccttcttaggcttgccatcaacaagaatgcgaactttttgcaaatttggcttccagctgcgacggcttgagtttaaagcgtgtgaacgtttgttaccaaagtgggtacgcttaccgttaataaaatcctttgccatgggtaacaaatctcccttctctttgattttagtgttaaagtctgtttcattacactagaataatttatcatacatacattgatattgcaatacttttctttcaagtaattatacttgacagtcttcttgggggcatcaagattactttggtttttagcgttattgtggtaatattaactatcgttaataggttaatagaaaattaaggaggctgctgcacatggccgtcaaaatcaaaaccagatttggaacagttgacatcgacaacaacgtcatcgcaaatgttgttggtggggctgccaccgataattacggagtcgtgggtatggcaagtcgcaatcagctcagagacaatgtcaacacgattttaaaccgcgagaattatttcaaaggtgttgtggttaaacaacacgataatgaaattgaagttaacgtttatattatcgttgcttatggcaacaaaatttcagaggtttctaaaaacgttcaagcaaaggttaagtataacctacaaagtatgcttggggtatctgcaaattcggtcaatgtcatcattcaaggcgttcaggtaatgaatgactgattatgcaagtgaccaaggaggacaagttgttgaaagttacagaaattaccaacaccgaatttacggcaatggttcaagcagccgcaactaaactaaataaaaattctgattttatcaattcactgaacgtattcccggttccggatggagataccggaaccaatatgagcctatccatggcttcgggttataaatatgtgaataaagatgtcaagacaaacgttggcgatttaaccgctgctttggctaagggacttctaatgggagcccgaggcaactcaggggttattttatcgcagattttccggggcttttcgaagtccacggagggtaaagaaactttgagtgcccaagatatttctgatgccttcgttgccgggacggaaatcgcctataagtccgttatgaagccaaccgagggaaccattttgaccgttgtgcgaatggccgctactgctggtaagaaagcagccgctacgaccaatgatgttgtcgctgtcatggatgccatctaccaggcctcacaatccgctttggagaaaacaccggatttattgccggttctgaagcaggttggcgtcgtcgactcgggtggacaaggattggtattcgttttggaagctttcgatgatgtcttgaatggcagaaacgaagctgaatctggtgaatatcaacctaacgatgcggaaatgaatcagatgattaaagtggccgatcaaagtgttcaaagtaaattaaatccagaagatatcgtgtatggctactgtacgcaaattatggtccgaatcggcaaaggccgcgaagtcgatcatcaatttgactatcagaccttttatgattatctcgccaaacttggcgattcattgctggtgatcaacgatgatgatattgtcaaagtccatgttcacactgaacatcccggcaaagtgcttgcctggggtcaggagtttggagatttggcaactgttaaagtcgataacatgcgacttcaacaagaaaccatcattgaagaagatgaggacagccaagaggatgcttcaccaattcaaaaagctgaaagtatcagcacccaacagccaacttcagatactgccattatttctgtttcttcaggcaaggggctgaaccaactgtttgaaagtttgggcgtcaactacattgtcagcggcggacagacgatgaatcctagtaccgaagacattgtcaacgcaattcaaaatacaaaagccaaacaggcaatcgtcttgccgaataacaaaaacattttcctggcggctgaacaagctgccaaggtggttgatattccgacggtcattgttcattcaaagacgatctcacaagggattaccgccatgcttggctttaatccggaaaattcgctcgaagataaccaaaaggcaatggaagataatttgccaacggttaagtccggccaagtgacgaccgccattcgtgacactaagattgttgatttggatattaaaaaagatcaatttatgggcatcgttgacggcgatattgccaccgttggtgataaactgattgacacggccatccagatggttaagaagatgctggatgacgatagtgaagccattacgatcatttacggtgaaggcgctgatcaggcggctgccgaaaaagtccaggccggcattttgaaattggatgacgaactggaagttgagattcacgaaggtgatcaaccagtctacccattcttaatttcggttgaataaacaattcctaaaagtttggtcaacactggccaagcttttatttatatcaatgacaaaggagggataacattggccagcttaagtgattcggttggggttctcaaaggagtcggcgaaaagcgcctgactgcttttaataagctcggaatcaataccatcaacgacttactgacttattatccccgccgatatgatgatttatcgctaaaagatttaagaactgccgtcgatggccaaaaagtcaccgtcaaagggatcgtgattagcgagccaactgttcgtttttttggtcggcgcaaaagtcggcttggttttcatttaaaaattaatgatgaaatctataacgtcactttttttaatcagccgtggctgaaaaagcagcttgagttggaagcccaagtgattatttttggtacctttgaccgcaatcgtaaccagattcaagggatgaaaattttaaacggcgaaaaaagcgaaacctatgattcaatctatccaagtaacaaagaagtcaaacaaaataccattaagcaattgatcaagcttggatttgatgaataccaggatcagctagttgacgttattccagaatcaattcgcaccaagtatcgattggaatctttccacgataccattcaaaatatccattttccaacatcaccggtcgctgcccaaaaagcttttcgaactgccaagttcatggaatttttcttatttgccatgaaaattcaaattttaaaacagcgccacagaaaaccggatccggcagccaaagtcacctacgatcccgatctggttgggcagttcaccagtcaactaaaattcaaactgaccgattcccaaaacaaagttgtcaatgaaatcttgacagacttgggcaaaccattggaaatgaatcgcttgctccaaggggatgttggtagtggcaaaactgtggttgctgcaattgctattttggcagcgattagtgccggcaaacaagccgcaattatggccccaactgaaattctagccgagcagcatgccaacacgtttgccaagttgtttgaaaaatttgatatcaacattgccctgttgaccggggcgaccactggcctagcccgtaaggcgatgctgccacggattgctgacggcgaagtcaatctgattgtcggcacccacgccttattccaagatcaagttgactatcacgatcttggtttggcggtcattgacgaacagcatcgcttcggggtcaaccagcgccaggccttacgactgaagggaaatagtaccaacatgctggcaatgactgccacgccgattccgcggacactggcgattacgatgtacggtgatatggacgtttctgtgatcgacgaactgccaaagggccgcaagccaattaagacaacttggattacctccgctaaaacggatagtgccatccgattcgttaagaaacaattggatgccggaaatcaagtgtacgtcgtcacaccgttgatagaggaatcggaagctgtcgatatgaagaacgccatggcgattttcgaccgtttcaaagcgatttttgaaccgcagtattcggttggtctcctacatgggcgaatgtccgatgaagaaaaggatacggccatggccgattttaagaacaatcaattccaagttctggtggcgacaacggtgattgaagttggcgttgacgtgacgaatgccaataccatgctgatatttgatgccgatcatttcggtttggcacaactccaccaacttcgcggtcgcgttggccgtggcgacacgcagtcctactgcattttgattgccgaccccaaaaacgagttgggtaaaaagcggatgacggcggttgccagcagcaccgacggctttttcctctcccaaaaggatttggaattgcgtggccaaggtaacatcaccggcagtaaacaatcagggatgcctgatttcaaagtggccgatccggttggtgatttgaatattttacaagttgccaatcaggaggcccagagtattacggttcatcaagactggcaaaagcagccagaaaatgtacaattatcacagtatttaaaatataatgaaactattactacggattaaataggagttaaatatgaaaattgcagttgacgccatgggcggcgattacgcccctaaagaagttgttgaaggaattgaattggcacgggatgcttatgccgatgttgaattccaactatttggtcaaaccgaccaaattaaaaaatatcttaaaaatgatgatcgaattcagattgtccaagccgatgaagtcatcgaaatgggtgatgaaccggttaaagccgttcgtaccaaaaaacaatccagcatcgttctggcagcaaccgccgttaaagaaggaactgcggatgcattcttctcggcagggaacactggtgccattttagccgctggtttgtttatcgttggccgcatcaaaggaatcgatcgtcccggattgaccaccactttgccggtcatcggcgttaagaatcaagataaatttgtgatgattgacgtgggagccaatgccgacaccaaggttttaaatatttaccagtatgccttgatgggaaaatattacgcccaaaacgtcaaccaagttgaaaatccacgaattggtctcttgaacaacgggaccgaagcggataaaggtgatatgaatcaccggaaagtgcatgatcttttggcagccgacaaagatatcaattttgtcggcaacgttgaatcccgtgaattactcaacggggccgccgacgtggttgtgaccgacggctttaccggaaacgccgtattaaagagcattgagggaactgctttgtcgatgctcagcttaattaagacgaccatcatggatagcggcactaaggcaaagtttggggctttgatgttaaaagacgctttccacaaaattggtggttcaatggactattcacaatatggcggcgcagttttactcggcgttaatgcgccggtcgtcaagacacatggcagcagcaaagcagacacggtgaagaatacgattggccaaatccgccagattattgcctcaaatatgattcctgatctgaatcaatacgtcgtcgaccatgctgatgaactgcagcagataaaagatagtatcaaaagcagtaaatagttgatataataatcattagcaaattaattttatgaaataggtgtttatcaaaatggacaaagatgaagtgtttaataaaattgccgatttggtggctgaccagtttgatgtcgaccgaagtaaaattaccggtgacttaaatttcaaaaacgatcttgatgctgattcaattgattttgttgaattcgtattggatatggaagatacttttaacgcagaaatttccgatgaggatgctgaaaagctgaataccattaacgaggccgttgattttgtcatggctcatcaaaaataataaaagtaatcttaaattggaattatctcaagtttgatataatttcaattttttactgttatctggattttatgtggaggtaaaagattgataaagggtttaaatgagatgctaaagcaagattttggcatccatatcgacgatcaggatttgcttgatgaagcattcacacaggcttcttacgtcaatgagcatcgcggtgaaggcttaaaattttatgagcgtctggagtttttgggggatgcagttttacagctgatcgtctccgactacattttcaaacgttatccaaagatgcctcaaggacggctcacgcgacttcgagcagcaatggttaatgagcaaagtttcagcacctttgccagagaatgtcattttaatcagtatatccgtctcggtaagggcgaagaaaaggcgggggctcgtgatcgggactcgctgttatgtgatatttttgaatcattcgtcggctgcctttatttggaccaagggcaggccgaggtaacacggtttgtgaccaaagtgatttttccaaagctcgatgaaggcatgtttgccgaattctttgatcataagaccgagttacaagaactcgcccaagcagacggtccggtggccatcgactatgaattagtggacgaatacggacccgacaacgaccgttcgtttaaggtcaacgtctcaattgacggcaaactttacggtgttggaattggccattccaagaaaggcgccgagcaaaaggccgcccaacaagccctggaacagtttgataccgagggcgacaatctagtttagactggagaatgagtgtgcaacttaaatccattgaaattatcggttttaaatcatttgcagacaaaaccctcatcaagtttccgggtggaatgactggaattgttggtcccaatggaagcggtaagagtaatattgccgaatcaatccgttgggtaatgggggaacaatctgccaaaaatctccgtgggtcgcggatgcctgatgttattttttcaggctccgccgatcgacggtctttaggcatggcctcggtgactttaaccttggacaactccgaccatttcattaagtctcccttcgatgagctcaagctttcccggaaactctttcggaacggcgatagttcctattatttaaacgaaaaacagtgtcgtcttaaggacattaccgatttgttcatggataccggcatcggtcaagggtcattgtcgatcatttctcagggtaatgtggaacaaatcttcaacagtaaacctgaggagcgacgatcaattattgaaaatgtcgccggcgtctacaaatacaagcagcacaagaatactgcccaaaaagaaatcgatgagacttccgataatctcaatcgagtggaagacatcatttctgaacttcaaagtcgaatggcaccgcttgaagagcaaagtagtctggcaacggattatctggatcaaaaaaagcgtttagatcagtttgaaaagcagcagttaattttggcaactcagaaattgatcgcagccggccagcagctcaaacacaccgttagtgaaaagtctgacttggttaataaaatttacgctcaagttcgccgggatgaaaatgaccgcgacaaactgaaagccaatttaactcaaaaccgggcccaaatcgaccaaatcaacgagcaaattctgacagcaaccgaacaaattcagtcgctgaagagcaagcatcagttgtccgcccaagagaagtcttttaaggacgccgatttaaaccggatttcggaacaaatcaaactgactgacaagcaaattgacgattttcaggtcaaactcacccaatcggtggatgccggcaaacggctatcggaaaaaattgctgccaaacaagccgatttcgacaaactggcagaagcccaaaaagcgaatagcgtttcggtaattgaatctgaaatcgaccaattgcgtaatcaatatgtcgacttactgcagcaaaaaaccgacattaaaaatcaaattaccatgaaaactcatgatgaagcccaacttgagcagcaactggggtcacagcgacagcggattaataaagtgcgcgaagaccttggccaaacccaggcagaattggctaacaaacaaaccgctctagcatccagccaatctgaattgacggatgtttccaagcagctggctgatttaactcaattaatgaatactcaccagcaggctgtcgacagttcccaagccaattggctggcagcactcaaaattgccgagcaggccaaagcaaaagccgagtctttgaagaatctccatgactcttatcgtggcttttatcggggcgtggcgaatcttctcaaacggaaaaaccaattaaccgggattttggggccggtcagtgactatttaacgattgatcaacgatatgtgaaggccatcgagaccgcattaggatctcaagcccaacacgtcattgtcgaggataaccgggccgcttcctccgccattggtttgctgaccaaagagcgtttggggcgggtgaccctgctgccaatttcaaccattaaaagtcggtggctaagttcgacaatcgtccacgagtcacaagaagttctcggattcattggtgtagcagccgatttggtatccatgccggataatctcaaccagattaaaggcttccttttggggaccacgattatcgccgatacgcttgaccacgcaattaacatttccaagcaaattaatcagcgcacgcgcattgtcactttggatggccaagtcgtcaatgccggtggatccttaaccggtggtgccagtcgtcatgataaccaaggggtgttggttcaaaaatccgagttggccgctctcaatcaatcgaccgctcaaatggaccaaaagctgacggaaaatgaacgtcggctccagcatgccaaggatgagctggctaaaatcactgcgtcacatgagcgtggtcaacgaaaagcgttcgaaattcgccaacagaccgcaaccttggaggaccagtgtcattcacttgaagaggctgttcaggaaaagcagcgtgaatttaagaccctccagctcgctttgaagaacgctgcccagtccgatggaacaactgacaccgaccagctggtcaaccgtcaggatgccatcgacaaacaattgcgggcagtcaatgacgacttggataacaaacgggttcaactggcaaacgttaaacaatcggctcaaaaatttaccacggaaaagcaacaagtccgagaggcgattgttgttgagcagcaaaagttgaatcagcttgaagttgatcaaacaggaatcaaaaagcagattgcgactcatcggcagaatcgggaccgcctgatcaaacagcgagaccacttaaaggctgaactcagtcgtcaagtggacgcggggacgttgaacgagcaaattaagactgccgaagccagccaacacgcacttaacctgacgcaaaacaagttgaaagccaccgttggcgaagcgcaggatcatttggatcagttaaatcaaaagattcaagatgagcagattaacttgaataacgccaaatatgaacttaccagtgcccagacagctgctgctaaaaaccaccagaatctggataccaactttgcgactctggaaacgacttatcagatcgatcaacatgatttagcgaatcccgactggaattgggatgaaaagcaggttgccagccaaattaaaatgctgcggaccgggattgacgaaattgggccggtgaatatcggtgccatccaggaattcaaggaagtttccaaacgttttgaatttttgaccagtcaaaaacaagacctcttggatgccaaggatcatttaaccgccaccatgcgcgacatggatgacaccatcacgactaaatttgccacggcgttcaaacaagtcagccaagccttttcaaaagtcttcgttgatatgtttggcggcggtgaagccaaactggtcttgaccgatcctgatgatatgttggatactggaattgagattatggttaagccgcctggcaagaactatcgcaacttaaatctcttgtccggtggcgagaaagccttaacagcgatcaccatgctgtttgcgatcattaaggttcgaccggtgccattttgcatcttggatgaggccgaagccgcccttgacccgtttaacgcagaccgctttgcaaaatacttaaagcgttttggtgatgagacccagtttgtggtcatcactcatcgaaaagaaaccatgatttacgccgatcaactgtatggggtaacgatgcaggaatcaggcgtttcaaaagttgttactgttaatttagataatttaaaaacggaggtgagttgattgggactttttgatatatttaaacgtcgttccaaaaaagacgatgaaaaaaagccgactgaatcaactgaacaaaccgaacccaaaccagaagcacctgccaaagacgaccaaagcgccgccacttcaaatcaaacaaccacagatgttgaagagtccgccaaagccactaagaggccggctgatgaaccagctgaaaagaccgaagaacaaccgacagaacagcctgaagaatcaaatggccaacaaaccacaaagcagccggacgatgctcaaaaaccagcaccaactgttagtgaaccaaattcatcggctgagcaggaatcttcgacagaagagtcgcatatgccagctgagcctgaaaaatcagctgaaagtccagaaccggcagaatcagccacagattcaaatactcagcaatacgaaaaaggattggaaaagtcgcggtcctcgtttggtcaaaaactgaatgcccttttagcaaacttccgtcacgttgatgaatcattttttgacgacttggaagacatgctgattgaatccgacgtcggttttgaaacctcgatgcgaattgccgatgagttgcgcgatgaagtcaagctgcaaaatgccaagaagcccaaagatgttcaaaacgtaatcgttaaaaaattgattgacatgtacgatcaagccggcaatggtgaaaattcggccattaacatggcaaaatccggtccgacagttatcatgtttgtcggtgtcaacggggttggtaagacaaccacgattggtaagatggctaagatgtataaagaccaaggcaaaaaggtcgttttagccgctgccgatacctttagagccggcgcaattgaacaactcaatgtttgggcagaacgagatggtgtggatatcgtcaaaggcaaagcgaaaagtgatccggcatctgtggtctacgatgcggttgttaaagccagaaaagaagactatgacatcttaatggttgataccgccggtcggctgcagaataaggtcaacctcatgaacgaattaagtaaaatgaagaaaattctaactcgtgagattcctgaagccccacacgaagtcttgctggtacttgacgccaccaccggccaaaatgccatgactcaagccaaaatgtttaaggaaaccactgatgtttccggaattgttttgaccaagcttgacggcacagctcgtggtgggattgtcctcgctattcgcagtgaattacatctgccggtcaagtacgttggtttaggtgagcaggtcggcgatttgaagccgtttgatccaaacgactttgtttacggtttattcaaaggcctcatttccgaatagtcaggtattttaacgttgactgacgttatataaatctgtacgctagatgacgtattggccgtcaaaggagtttcaatatggaactggaaaaaaataactacatcaattctttgtttgaattttacgagccactgctcaccaaaaagcaggccaactatattgaactgtattatgctgacgactactcgctgggggaaattgccggtgaatataacgtcagtcggcaggccgtctatgataatattcgccgttccgagaagattcttcagcaatatgaagacaagctgaatttgtatcacagctttgttgaccggaacgacaaactagaccacattcaagcttatattcaaaaaaaatatccacacgatgacaaactgaattcaatgatcaaaaatttggaaacaaccgaagaacaataaggggtgaattaattggcttttgaaggattaaccgagcgtttacaaaacgccatgaaaactttacgtggcaaaggaaaagtttcccagtccgatctgcgggcaaccatgcgggaaatcagactggctttactggaagccgatgttaatttccaagtcgtccgtgactttgtcaaaaccgttgaggagcgtgccaacggtgccaaggtgttggaagggctaaatccctcgcaacaaattgtcaaaattgttgacgaagagttaactaaaacgatgggggaagaagctgttcccctgaataaagcagaaaaaatccccaccattatcatgatgtctggtctccaaggtgccggtaaaaccacaactgccgggaagttggctttaaaattaaagaatgagcagaacgcccgaccgttattaattgccgatgatatctaccggccggctgccattgatcagctgcagacggttggtcagcaaatcgacgtccccgtgttttcactgggaacggatgttgacccggtcgaaatcgccaaacggggtgtcgaacaggccaagcaagaccataatgactacgtgatcattgatacggccggtcgtctgcaaatcgacgaaaagttgatggacgaattaagtcatatcaaggatgccgttgaacccaacgaaattctgttggtcattgatgccatgactggtcaaaacgccgtggcgaccgccgaaggatttaataagaccttggacgtaaccggagttgtcttaaccaagttggatggtgacacccgtggtggtgccgcactttcaattcgggccgtcactcaaaagccaatcaaattcgttggtcagggtgagaaaatgtctgatttggacgtcttctatcctgatcgaatggcttcgcgaattcttggaatgggtgatatgctttcactcattgagaagactcaaaaagagtatgatgaaaagcaggctcaggaattatctgagaaaatccaagagaatacctttgatttcaacgattttgttgaccagttaaatcaaattcaaaagatgggacccttggatgaaatcatgaaaatgattccggggatggctaataatccccaattaaaaaacgccaacatggaccctaaagacatggaccacctgaaggcgattgtctattcaatgaccgatcaagaacggactgaccctgatgtattaaacccatcaaggcgccgacgaattgcccgcggttccggtcgaccaatccaagaagtcaatcgaatgattaaacaatttggccaaatgaaaaccatgatgaacaaggtttccaaaggcaacatgtccggcatggaaaatatgatgaacagtaccggcatgggcggtaaaatgtccaaactggcaatgaaacagttcagtcgtaaaatgaaaaagaataagaaacgccgtttgaagaaaaagaataagaagcgccgttaattctgacaagttatcagcattgacacgccattaatttggtcagtttggccaaaacaagtcaatccgtcagttcttttgatggtgtaaagaaaaaaacctttacaagcattcgaattactggtatattattaatcgttaaaacattacaggaggtaaaagcatgtcagttaagattcgtttaaagcgcatgggttcaaagaagcgcccatattaccgtatcgttgttgccgattcacgtagtcctcgtgatggtcgtttcatcgaaaacgttggtacttacagtccattaactcagcctgccaagattactcttgaagaagagtcaatcatgaactggttgaacaatggtgcccaaccatctgatactgttcgtaacatcttatcagatgccggtattatgaagaaatatcacgaagctaaatactcaaaaaagtaagtgagtgattatcatcatgacaagtattgatggtttaattaataagattatctcaccgttggtagactatcctaaggatatcgagatttcgcataatgaatccgatcgatttatggaatatcatctgaagttgaacgaagaagatattggcagaatcattggaaagcatggccatgtgattcagaccatccggaccattgtttacagtgttccggttgagggtcaaaagaaagctcgtctgattgtcgacgatgggaaacaatagggttcttaagcgaaacgaaggttttgtttaggccctttttctttattcaaaatgagattcattagagctggaggagtgagtgaatgaattattataatattggcaaaattgtcaatacccaaggcttgaaaggcgaagtcagagtgatttcgattactgattttccagaaaaacggttcaaagtcggcaacacggtttttgccaaattgcctaacaagcacgaacaagtggcgctgacaattgacggtgtccgcaagcacaaaggatttatcctattgcacttcaagaatcatccctcgatcaatgacgttgagtacttaaagccatcagaacttaaaattgatgaggaaagcctctcaagtgatgatcttaagcctggtgagtattactaccaccaaatcatcggcctggacgttgttgatccaaatggtaacccaattggccaagtgaaggagatcctctcacccggcgccaatgatgtttgggtggttgaacgcgatcagcaaaaagatttactgctgccaaagatcgattctgtcattacgaatgttgaccttgatgccggtaagataaccgcagatgttccggagggcttggacgaatgagaatcgacgtactgagtttatttccagaaatgttttcagtcccgatgcacgattcgattattggaaaagcaattgaaaatcacattattgatttagatgtcaccaattttcgtgaatttaccaccgacaagcaccgtcacgtggatgattatccctttggcggtggtgcgggaatgctgctgcaggcgcaacccattttggatgcgtacgaccacaccaaacaaactgctgaagctgccggctatcctaagggcaaagtgattctcatggatccggccggaaagccattcaaacagcatgatgctgaagagttgtcacatgatgaccatttaacctttatctgcggtcattatgaagggtatgatgaacgcattcgttccatcgtgaccgatgagtattcattgggggactttgtcctgactggcggggaattgcctgcgatggtcatgatcgacgctattacccggctaattcccggtgttttgggcaatcatcaatccagcgttgaggaatccttttcaacgggtctcttggaagagccccagtatacccggccggcagagttccggggaatgaaggtccctgaagttctcatgaacggcgaccataaaaaaatcgccttatggaatcaaaaggaggcattgagacgaacttacctccggcgacccgatctgatcgaccatcacaatttaaccagcacccaaaagaaattgttggctgacgtccggattgaggaagaagaaaagcaagccgcagaagatactgacaagaaaaatacctttacagacgatgaataattgtgttacactaatttttggcgcaagccgcaaaacaacattccgctgtcagacaagataatgaatgttagtgaaaggaagatttgtttatgcgacaaaatcaattgattgacaagatcaacgagaagcaactacgtaatgacattcctgatttccgtgccggagattctgtaagagtttacgttaaggttgttgaaggtaccagagaacgtattcagttgttcgaaggtgttgttatcaaacgcaagggttcaggcattcaagccacttataccgttcgtaaagtaagtaacggtgttggggttgaacgaattttcccacttcattcaccacgagttgataaaatcgaagtagtaagacaaggtcacgttcgtcgtgccaagctttactacctgcgtgacttacaaggtaaggctgctcgtattcgagcttcccttcgttcacgtggataatgaatcaattagactggatcgaattattcgattcagtttttttgtattctcgtttttaggttccaggctaccacaatgcttaagttctggttaagactagcacaatcgattgatgactgctaatcaggtcggtaaaatgacgcttattcgatgattatgatcggatttagttttggttaatttcatagcaaactgcgcacaaacggcgtttatttgctatcatagatattaggacatgaacacgattacatcgttgaaggtgatagttatggctgaatcagatgaagatcaaaaaaatattcaatggtttctgaagtatttacagagtgaccgtcactattctactgataccatccaggcttatcagcaggccattgccgaattcacccgctttctggccgaaattcccagtgaacgcaaaccattgacccaagtggactcgtttgatgttgaagcatttttgagcgatctttacgagcgaaagtacgccaggaattccatcgcccaaaaggtgtcggcattaaagtcgttctatgctttcctggtgaagaatactgtgatcgccaacaatccattcgaatatgtccacttgaagagcaatcatcggcgtttgcccagatttttgtatcaaaatgagatgcgggcgctttttcagggagccagacaaaatcccaatcaccaactgggattgcgcgatacggctgttctggaaactttatatgcgactggcattcgggtcagcgagtgcgccggaattcagctcaatgacatcgatttggacaaccgaaccatcttagtcactgggaagggcaacaagcaaagatacgtgccctttggggaatatgctcaagaggcgattgaaacttatctcagcgacgccagaagcccaatcatggccaagtaccatcaagaccatccatttttatttgtgaatcattacggccgaccgctgacaagtcggggcatcgaatatctgatggatcaaatcgtcaaacaaagtagtctgacgacgaagattcatccccacatgctgcgacacacgtttgcgaccgaaatgctcaataatggtgccgatatgcggtcggttcaagagttgctgggacacagcagcctgtcgacaactcaaatctacacacacgttaccaaatcacatttaatgaatgattataaaaagtattttcctcgaaataatgattcattaaaatcaaactaacaaaggggtatattatgccaatcaaatttgaagcaactactatcgtcgctgttcgccacaatggccatctcgcaatggctggagacggtcaggttaccatgggtgaaaaagtcattatgaagggaaccgcccacaaagttcgtctgatttatgacaaccaagtcgttgtcggctttgccggaagtgtcgctgacgcctttaacctcgaagaacgatttgagaagaaattaaaccagtttgacggtgacctgaaacgttccgccgttgaactggcccaagagtggcgtggcgaccaacagttacagaagctcgaggctttgttaatcgtgatgaacgacaaagatttattgctggtatccggtcaaggtgaagtgatcgaaccggacgatgatattttagcaattggttccggcggtaactttgccttagctgcggcaactgccatgaaacatcatgcccaagacatgagcgccagagaaattgctgaagccgccattcacattgccggcaacatcgatattttcacgaatcaaaacgtgatttctgaagaattataggaggaacttaaattgactgagtctactcaaacaccaaaagaaattgtttccgtgcttgaccaatatattgttggccaaaacgaggccaaaaaagcggttgctgtggccttgcggaaccgataccgcagaatgcagctgtcaaaagacatgcaggatgaaatttcaccaaaaaaccttttgatgatcggaccgaccggagttgggaaaactgaaattgcccgccgtttggctaaaatagttaacgcaccgtttgtgaaggttgaggctaccaaatttaccgaagtcggttacgtgggtggcgatgttgaatcaatggttcgtgacctggtcgaaaatgccatccaattggaacgggctgatcagtacaaacaggtccatgtcgaggcagaaaagcaggccaacaatcgcttggtcaaacttttggcaccggcaaagaaaaaagagaaccgccaaaatgagatgcagaacctgatgaatatgtttactcagatgcaaaatggccagatgccgtctgaaaatcaggacgatcaagaagaagtaactgatgatatccgtgaaaaacggatgtcgatcgcagaaaaactcaaggccggtttgctggaaaacgaccaggttgaaattgaaatggatgatccatcccaacaacccgctggtcaaagcacgatgatgaaccaaatggggatcgatttgaatgataccttagccggactgatgcccaaaaagaaaatcaagcgcaccgtccctgtaagcgaagcgcgtgaaattctaacccgccaggcttctgaggaattgatcaacaaggccgatctttaccataatgcgatcgttcgcgccgaaaataccggaatcatctttattgatgaaattgataagattgctccgggaaagtctcaaaacagtggcgaagtttcccgtgaaggggttcaacgcgacattttgccaatcgttgaaggctctcaggtgaataccaaatatgggaccgtcaacacggatcacatgctcttcattggttcgggtgcctttgccgaaaacaagccctctgatttaattccagaactccaaggacgtttcccaatcagagttgagttaaatgatttaaccaaagaagactttgtccgcattttgacagaaccaagcaactcattgaccaaacaatacattgcgttgatcgggactgataatatcaaagtaaccttcaccattgaggcgattaatcgaattgccgagattgctactgacgtcaaccacaatactgataatatcggtgcccgtcgtctgcacacgattcttgagaaactgcttgaagatatcctttacgaaggaccggatatgcagatgggcgatattacgatcactgaaaaatacgtcgatgataaagttggcaaactggctcaaaataaagatctttcacgttacattctgtaaaattgggaggaagagattaaatgattaccttgaaaaatcagtatttgaccgtgctcatcaacgagcagggtgccgaactcacctccgtgaaagatactgacggattagaatatatttggcaggcggatccagcattttggaaacggcatgcgccaattctgttcccgatcgtcggtcgacttaaggacaaccaatacacctatgctggccatacttatgaaatgacccaacacgggtttgcccgggacaatcagtttgaagttgaatcccaattaccaaccaaagtctcactggttttgcggcccactgaggaaacgttggccaaatatccgtttaaattcgaactgcgaatcatttacgaactggtcgatcatcaattgaatgtgagtctaaacgtcatcaatccaagtcaagacacactgttattttcaattggagctcatcccggctttaacattcctttggtcaaaggggaaggtaacttcgaggattcctttattcgggtagcaccaaagaagtcatacgttcaaatccccttaaaaccgccgtatagcgatccaaacgatccccaggcaattgacctgaccaagccgctgccgttgaaccacgagctgtttaacagcgatgccatcgttttgagccttgatcgccaggaaacgactgtgatgctggccaatgcccaaaatgatcatggtgtttcactcacggttgagaatgcaccatatgtcggtatctggtcaccgtacccaaaaaaagccccatttgcctgcattgaaccgtggtggggactggctgatacagtgaatgccgacggcaagctggaagataaatttgcgattaatcagttggctggccgccacgcctttgccggccgatattcaatcagtttcttctaattgatagtagctgtcgcatcaattgtccggccgattaaaatccaaactaaaaacgagtgattccttatttcagaaatcactcgtttttgattggttattcattcggatctttacgttttcgcagccgattgccaaggccaaatggcaccatactttcggtgccatttttaattcggttgatattggcccgatgccggtaaaaaatgaaaaaggtcaggatcaccgccatgacactcaataaaatgtcgtgggtaaagaaaattgcgatggtcgttaaggtaaaaccgatcatgctggcaagactgaccatgctggttaacaaaatcaccagaatccaaatcccggctgccaaaaagaagaaagccggcttgtatgccagcagcatccctgcactggttgccaccgccttgccgcctttgaatttatcaaagattgaaaaggtgtgccccaaaatcgccatgaatccaaagatcaacggactgatcgcggtgatatgaaaaaatgtcggcagtaatgtcgctaccgctcctttagaaatatccagcgccatgacaatcgcgccggcaatcggccctaaaacccggtaggtattggtagtcccgatattgccggaaccgtgtcggcgaatatcaatgtgaaagaaaattttaccaatccagacaccgctgggaattgatcccagcaaataagctagcactaacagcattataatttgttcaatattagaattcatctcaaacctcacaatagtcgcaattaataaacttaatagcgtttctcattttagcatgtaatttgagttcagccaataaaatttcgtttccatcggcgtaaatttaggttattatgaagtagattgcaaaaaaaggagtcataacgaatggtaaagcaaaagcaaaaatatgatgattcctcgattcaaattcttgagggactcgacgcggttagaaagcgtcctggaatgtacatcggttccactgattcacgcggcctgcatcatttggtctacgaaattgttgataatgccgtggacgaagttttggccggttatggggacgaaattgacgtctcaattcataaggacaacagtatcacggtggtcgatcacggccgggggatgccaactggtatgcacgcttcagggaaaccaactcctgaagtgattttaacgatgcttcatgccggcggtaaattcggtcagggcggctacaaaacatccggtggactgcacggcgtcggcgccagcgttgtcaacgcactttctacttggctgaaagttgtgattgtccgtgacggttaccgttacgaagaagatttcaaaaacggcggccatccggtgggcacactgaaaaaattgggcaagacccgcgctcatagtgggacaacggtaacctttaaaccggatccaactattttcaccagcacggtttacaatttctcggttctttccgagcgattacgggaatccgcctttctacttaaaggaaccaaaattaccctgactgacgaacgaaccgatcaggagcaggaagacgttttccattacgaagagggtattaaggaattcgttcaatatttgaatgaagataagcataccctgggcgacgtgatgtatttcgacggcaaaaaagacggcgtggaagtcgaagtggctgcgcagtataacgatggttattctgaaaccatgctgtcatttgttaacaacgttcgaaccaaggacggcggcacgcacgaggcgggtctgagaaatgcttggacgaaagcctttaatgactatgcccgaaaagtggggatgctcaaggaaaaggataagaaccttgaaggcagcgatgtccgcgagggactgtccgtcgtattatcgttacgaattccagaagaaattctccaatttgaaggtcagaccaaagaaaaactaggcacccctgaagcccgctcaatcgttgataacgttgtcagtgagaagctgggctactatttgatggaaaatggtgaatttgcccagactctggttcataaagccttgcgtgccagacaagcccgacaggcggcaagaaaagcccgggatgaaacccgaaccggcaaacggcataaaaaacaagaacgcctgctgtcaggaaaattgaccccggctcaatcaaaggattacagccgaaatgagctgtttctggtcgaaggggattcagccggcggttctgccaaacagggccgagaccgaagatatcaggcaattttgccccttcgagggaaggtcttgaacaccgaacgggcaaagctcccggaaattatgaaaaacgaagaaatcaatactatgatttatacaattggtgccggcgttggtgccgattttaacattgatgatgccaactacgataagattatcattatgaccgatgccgatgatgacggtgctcatattcagattctcttgttgacgttcttctacaaatacatgcggccaatgatcgataatggcagagtcttcatcgccttaccacctctttacaagctacagaagggtgccggcaagaagttgaaagtccaatatgcttggaccaatgaagaattaaataaggtatcaaaggactttggcaagggctacagcctccagcggttcaaaggtttgggtgagatgaacgctgaccaactgtgggaaacaaccatgaatcctgacactcggactttgattcgggttcggatcgatgatgccgctctcgctgaaaaacgggtgaccactttgatgggcgataaagttgaaccccgaagaaaatggattgaacataacgtcaaatttaatttagaagaagatggcagcatcttggataatacaagtgattagggggcgcgtctaaaaaatgagtaaaattgaaagtttgaccctcgaagatgtcatgggcgaacggttcagcagatattccaaatcaatcattcaggaacgggccttgcctgacattcgggatggtttaaagccggttcaacgacgaatcctttatgccatgaacaaagacggcaatacgtacgacaaaccgtttcgtaaatcagcaaaatccgtgggaaatgtcatgggtaattttcatccccatggcgacagttcgatttatgaagcattgaatcgaatgagccaagactggaaggttcgcgagccgctgattgaaatgcacggcaacaatggttcaatggacggtgatccgcctgccgcaatgcggtataccgaagcgcgtttgagcaaaatcgccagcgaaatgctgcgggatatcgaaaaggacacggtcgactgggtcctcaattttgatgacaccgagtacgaaccaactgttttgccatcccgattccccaatttgcttgtgaacggttctactggaatttctgccggctatgcgaccgatattccaccgcataacctcggagaagtgattgacgcgattctttacctgcagaagcacccggatgcaactctggatgatttgatgcagtttgtgaagggacccgatttcccaactggcgcaattgttcaaggaattgacggcatcaaaaaagcatacgaaaccggtcacggcaagattatcgtccgctcgaagacttccattgagccactgaaaggcaacaaatcacaaattgtcatcacagaaattccttacgaggttaataaggcccaactagtcaaacggattgatgaaattcgcttgaacaagaagatcgaaggcatttcggaggttcgtgatcaaagtgatcgtaacggactcagcattgttgtcgaattaaagcgtgatgttgactcaaaaggaattttgaactacctgttcaagaataccgacttgcaggtttcctacaatttcaatatggttgccatttcccatatgcggccggaacgtttgtcactgaaaaagatcttggtggcctatctcgaattccaacaagaagtcattgagaagcggaccaaatacaatttaaagaaggctcaggaccgtcagcatatcgttgagggattgattcatgccttatcaattttggacaaggtcatcaaaaccatccgagcaagtaagaaccgtaaagatgcccgtgacaatctggtcaaaacctacgatttttcagaaaaacaggctgatgccatcgtcgctttgcagctgtatcgtttgaccaatactgacgtgacagagttggagaacgaacaccagcacctggccgacgaaattaccaaagacaacaaaattttgaatagtccaaaagaactcaatcgggttttggccaacgagttacgcgcattggcgaaaacttatcgcagcgctcggagaaccgagattcaagctgaggtttcagatatcaagattaatacagatgtcttgatccctgacgaggatgtgatcgtgatggtcagccatgacggctacatcaagcgaagcagcattcggtcatataaagcttcgacaaccgacactggtttaaaagatgaagattatccaatctttatggccgaattaaatgcccgcgatcatctgtttatgttcaccaataaaggtaatctgatctatcggccagtctttgaattggcagatgtgaagtggaaggataccggtgagcatatttctcagaccatcgggttggatgctgacgaggaaatcattggcacctatgcttttgattcactcaagcaaccaggaaccttcttgattgcaactgaccaagggcatgtcaaacaaactggttttgcggatatgaagccgggacggacctacaagagccatgcctacacctatgagaagctcaaaactgctgatgagcgggtagtggccattcattatttgaagacgcccgcaactgctggacaaatgcttcttatctctaataatggcttagccttacgctatgggatcgatgaggtaccggttaatggcgccagaactaccggcgtaaaatccatggggcttcgaggtgttgataaagtcaccaacctccaactggtctctgaagacgatgtcttggcaattgtgacccaacgtgggtctttcaagaaattagctgttaaagaaattcctgccacttcaagggctcgaaagggcgttatgatcctgcgggaacttaaaaataatccgcacagaattgtggacttttgtcgaatcgaaagcgaagaccagccgcttgaagtgcggaccgatcatcgccgggttcacgatattttaccagcagattattcattgggtgggcgttattccaacggctcatttgtaattgatgttgacagtgaaggcaccccggtttcaatcagaccaaagtttgtcggcttatcaattgattaaatttttaccatattaattgattgtattaacaataagaattatcataatagcagtatcctgttaattatataatggtcgcacggaccgataaggagagtctgaatgaaaaccactcaggaaaatatttttgcatcaaagactttatcgtattttctccagttgtcagaaacgatgaactacacacaagctgcccagatcttgggaattacgcaaccagcgctgacccaacaaatcaagaagcttgaaaagacaatgggaactgaattattctactcggttggcaagaaattaaggctgaccgatgcaggtgtgatcatgttgaagacaacccggcagatatacgatctgttaaatgatgccaacgaccagattcaacaagctaccagctcaacgactggtcaaattaatctgggaatcctcgcttccgttgaaaccaaagtctttgaagattttgccctggcactttaccaggaaaatccggatttggaagtcaatttccacatgctgaccagaaaagagatttgggaaagcttggagaacaaccgaatcgatttggcaatcatgtacctgccggatgaatcgattaagaactggaagccatacagctccaagaagattatctcggatgacttattgtttatccaccacaacccaagtttggccaaacgtaaacgggtccacttgaaagatgtcaacgacaggccatgggtgatgtatccacaagattattatctcaaccaaactttgcgggaatcctttaagaaccaaatggtggactggccaaaggtagcggcacgatataccatgcccgagcagattttgaagttcgccattaattcccacaccaacacggcattaccaaagtcatatatgctcaatatcgaccttaagaagttgactgacgatgacatttgggtcactgaattggatcctaaagtcaagtttgatctgaatttcgtctaccggaaccgcaagaacgaaatcccgcggattgaacgtttcttacagaagttcgatgagttccttgctaaagaagattatttagcccgtttagggaaataaattttgattatcaaaggagattatgtaaatgagtaaagaattagtttttggtcatcaaagtcctgatacagatgcaatcgttgctgcaaaagcctattcatatctgcagaacaaattagggtatgatactgaagccgttgctttgggtgaacctaattcagaaaccgcatttgtgttaaattattttgacgagccgactccacgaattatcaaaactgctaaaaatgaagttgactccgtcatgttggttgaccacaatgaattccaacaaagtgtcagtgacatcaaagatttaaccatcactcatgtggttgatcaccaccgaatttctaatttccagactgatcagccactatactaccgcgccgaaccagttggctgctgcagtacgattatcgttaagatgtttgacgaaaacaaagttgaaatccctgctcaattagccggcttaatgctttcagcaattatttcagatacgttgttactgaagtcaccaacgaccactgaagaagataaaattgctgtcaagactttagctgaaattgctgacatcgattacgaaaagtacggcatcgagatgcttaaagctgggaccaacgtttcagcaaagacggaccaagaactcattgattctgatgccaagtcatttacaatgggcggtaagagtgttcggattgaccaaatcaacgtcgttgaattcagcgaaattgacaagcgtaaaaatgacattgagaatgccatgaaggctgaagctgctgataagggctacgacttgttcttagttctgattactaacgttttgaacagcgattcaaagatgattgttgtcggcgaaccatcatctgcagttgaaaaagcatttaacagcaaactcagtgacgacacaatgtcattaccaggtgttgtttcacgtaagaagcaagttgttccgccattaacagatgcattaagctaattcatcaactctttcaaacggtccggctaatctgaatggttagtttggccgtttttgtttactttgggttggttggccactataatgaatttagtttagttgtacacaacctaatttaatggagggttatcatggacaagcaggaactcaaaaacaaactaaccccggaacaatacgatgttacccaaaacaaagggactgaggcgccatttagcggtcagtatgatgacttttaccaagccggtatttacgtggatgtcgtgagcggagaaccgctgttctcatcgaccgataaatatgatgccggctgtggttggccatcatttacgaaaccgattgacccagccaatattgataagcacttggacacttcttttggcatgattcgcgaagaagtcaaaagtaagcaggcgggttcacatcttgggcacgtgttcccagacggtcccaaagatgctggtggtcaccgattttgcattaattcagcagccttaaaatttattccggttgccgaattggacgcaaagggatacagtaaatacaaacaattatttgaataaatgaaattgaggtgcaatgcatggaagatacagcaatttttgcaggtggatgtttctggtgcatggtcaagccatttgacactattcccggtattaacaaggtcgtttccggctatactggcggccatgttcccaacccaacttatgaacaagttgccagccacaccactggccacactgaagcggtcaaaattttctttgaccctgaggtaatctcgtatgataagttagtggaaatctattggcatcaaactgacccaacggacgccatgggacaattccaagatcgcggtgataattatcgtccggtaatttacgtgaaggatgagcagcaaagaaaaattgccgaagcttcaaagaaagccctcgccgagagtgaacaatttgacagtccaatcgtgacccaaattgaggatgccaaaccattctatccggcagaagaagaacatcaagaattctacaagaaaaatccgctccgttatcaaatggaagaaatgggcggacgcgaaaactttatcaagaagaactggcagaaaaattagttagccaaggatatttcagctattaatgaccattcacataaagggctgtgacaaaacgcaaattttgccaacagccctttattattttgaattaaactgtaaggagaaatcgtcagatgatcaaatggtcaaataagacaatcaaagcatttcaggagacgctactagcctggtatgaccaaaataagcgggatttgccatggcggcaggatcaggatccttaccatgtgtgggtgtcagaaattatgcttcagcaaactcaggtggaaacagtcattccgtattatttacggtttatgaacgaatttccaacgattgaagatctggctgcagccccggaggacaagctgatgaaagcttgggaaggactgggctactattctcgggccaggaaccttcaaaaggcggctcaacagattgttttcgattatcagggccaatggccaacgactgcaaaagagcttcaggaattgagcggtatcgggccctatacggccggtgccattgccagtattgcttttggccaaccagtggcggcagtggatggaaatgcctttcgcgtttttgccaggctgttagaaatcgacgatgatgttgctaaaccacacactcgtcaggtatttgaaaaaataatcaacccaatcgtttcaaaggatcgaccaggcgactttaatcaagcaattatggatttgggtgccagctacatgacagccaccaattatgataccagccaatcaccggtcaaggatttcaaccagtcatatctggatgggattgaagaccattacccagtgaagaccaaaaagaagcggccggttcgccacgattactttggagtggtcatccattccaaggcggggtacttatttgaaaaacgcccgagtcatggcattctggccaatttttggatgtttccgttatttgaccgcaaaaatttaactgatgaccaactggcgacagaatcaacgttaattgacataatcgaaacccgactaaagaccgattaccaactaagtgtcgcgttgcatccagtatctacgccaacggttgttcacacctttacccatcagcaatggaaaattaagttactggaaggccaaatagcggaagatattgatttaagctattttccgggtaaatggatccactccagtgaatttgatcagatgacattttcgaaagttcaatcaaaaatgtggtctgcctatcagaaagctgtaaaatcaactcaatcagttgaggggtcagctgtggatcaaaaaacaaatcgctgaggaattttgtggcaatctacccacgaatttttttagtgacgctgtttgtcacgatgaagtttatcaagggcttggcgttgcttggtgtcaatgatgtgcgtgtataagccagtcgcattggttgaactctggccaagctgagtggccaccaagtgctcattgttggtttccaaatagagcttcgaagccaatgtatgccgtaacttgtggggtgtaatccgcacgtggttgaaaacttgggagtatttcgccaccaatagttcaacagtcgcggtggaaattcttctgggttggcttgcccctttcgtcaaaaagagggcaggggtagtcttggtggccaaataccgttgcttacggacgtttaaataggttgccagatagggaagcacccagctggcaatgggcacggaatcgtacttgccgccttttcgccggacgacaattgccgctttgctcaaatttaaatcagagacatttgcattggtcagctcggacacccgaatgccagtgccaagcatcagcgcattgattgccacgtcacgttcacgatcgcgttgatataatgacagcgttcgtttattggtcagtgtcttgggatagtcattctggatgaattcaatgtatttcacatccgcgtcacccaacatgagttgatccttaatgttgttggcacgggtttgataggtttcgctgtcgggaaccaaggcaattttcttcatcacattccggtaaaaataaggctcaccatcggcagtttcattttcctccgataagtatcggaataaggctgagagcgcgttcagggaacgattgactgtccgatgagaaattggtgcttgcggatgggaagccgtttgcttgccacggttcagcaggtaagacttatacagttccatatcctgttttttgaagtgttccagcgcggagagtggaatttctttgacagttttcacgtcagtaatcccaacgtcgatcatccaagtgaagaagcggtaaaactcatttagatactgatatagcgtggcgggggataatggaaccgttgatttgtcaagataatattcattaatataagttggcagggtttgaaccagctgttgattgtgttgaatatattgagatgatttcatttttaagctccttaattcagttaatcatatcccagcaaatcgcagtaaatttggtggggctgtttattttttggcgtataacttaataaaatctgtattttattaagttaagtatatcataaataagcatattaattgacccaatgttggaatcgattaatattaataagtgaacaatccaatttgaaagaggtttagatatgagatcggatttctgattaaggaggttctaaatatggttgatttaaaattaattcatcaagttcaactgggtattctggcaaatgtggcagcaatcaattctaaataccatctggaatattttctaactggtggttcagcaattggtgccgtgcgtcatcacggctttattccatgggacgacgatattgatattggtttgccgcgcactgattttgaaaggtttctacaagttgcaccggcagagttgtcacatcgaggatacttcgttgaagagaatcgccttgatccacaatacgaatacgatttcgctaaagtgatggctgatggcacgcggatcttggaacatggccgtgagttgacaaaagccaagaatggcatctttattgatgtatttccgttcgatcgaatgccaaataaacgtccgcaacaggaaaaacagcaagcaaaattggcaatgctgttagaagagattcgaaagcgattttatcctgacctgtatcagcaaagtatcacacaatctaagtatgcggattataatttgagtgagctatacgatattcgactcagcacaatgacccaatataacggtcactcggaattatcgttgattaacatgtcatcaccgtatcagtacggaaaagaattaatcaagccgacagagatccatcatttaatcccaatggcctttgaaaatttacgggtgccagtcctagcagattatgatgcatacttaacacgcttgtacggtgactatatgaaactgccaccgttaaataaacgcattcagcgtcacgttttaaaagtacgagtggataattaccaaacgaacactcaagttgaatccggaaatcctctggaggaagccgttggttaattgttcacgaaattaaagtaaagaaccagttaccattgccgagagtgttggctttggtagctggttctttttaccttttctctacttcgtataatatatattatgtaaagtagaatccgtatcaagaaaaatgagtctgcaccccgcttctctgatacgtatctaaataattttattaaaacgaatcacgtcacttcgtttaacaaattttagatgctgccaaaatgattggcctgcaagattatctttcatgacattgacaaagattttatgaataccgacagcttggagctgttcaatcactttattgaccagttgagttcccaaaccttgattctgataacccggagcaactgccaaatgataaatcgtcccgcgccgaccatcagttgcacccagaatgctgccgatgatctgtttgtcagtcttggtctccgctacaaaacagaaattgggattgaatcgcaataatcgactgatttcttcaaaactatcgtcaaattcccgcagattcatgccgggaacttgttgccacaatgcataagcatttggataatcttctgcctgcatttttctggtgataatttgattgtccattgtgttgaaccttctttttaaataattgtatataccaataaccggttttacagaaacttttccttgatttgaatcggctaattgtatatggcaataatcatgatctcttatttttgccaatcatattagtgtaaaatatggttgaaactccaccggggcctcctgcctggtcaactgaaatattggcagctcagcatgatatttggtatgtggttcaatcgaggagaaccagtagcggaagtccagatgttgatgagcaccctcgcctttttgcggattagccggaatatcaatgatgttgacgtcgattaacgaattgggactagtttttaaaaccaaaccggtctcttcggtaaattctctgatggcacaatcaatcggcatttcgtttggctcaacgtgaccggcaggcaatagaattgtatgcaggtatgggtgccggataaagatccccttacctccttcaaagaccatcgcacttgcagacagatgaaatggcgatttccggtcgcgaagtccttgggagtttgccctcagcaactcgatagccgtctgcactttttgggtatttatccagggatatggctgactttttagcgttacgatttgggcgattaattgttcaactaagatggttgatcacttccttaatcacttaatatgtccttgaagatctgataggttttaatcagttcttgggtttctttgacgttatggacacggataattcgcccacccagttgggtcatgtatgcttcaaacagtaatgttgggatcagtcgctcatctgagcctgcatcaaacagtcgtttggcaaaacttttctgagaaattgcgatcatgatcggtgctgcaaactggcgcatttgttttgtgtaacgcattttaatcaaatcaaattcaagcgtattgctatcagagaagccaaccccgggatcaataacaatgttctctctttgaagaccagcttgttctaaacgattaatcgagtcagtgaaaaatgaatgcatcgtgtcttcaagtgtcgttggttgttcgtcaaaattgcgaccattaaacatcgtgacgactgagggttgatattgttgaaccaaatccagtttggcttgagaattaaagccatcaatatcattaatgatctgaattccagattgcaacgcccgttcaatcactgagttggtattcgaatcgattgccaatacaatatttggaaaccgtttttgaatcgctttaagataaggttctacccgctgccactcttcatctggactaatgtcatcaaaatggggtttggacgatttgccacccagttcaaagattttggcaccatagcccatttcagtttcgatgcggtccaaaacttgatcaatactggtattgaccccaccatcgtaaaatgaatccggggttaaattgagaatggaatagataattggcgttttagtcagattgaaatcaaaatttttccctttgaaatggacttcattagaattagtcatttgaattgctccttgtctttattaaataatctcgaattgggttgatgagataaaatgaacccaccaccaaaatgagctgatcggggtgattggctgattccttgaggcttgccttaagggcagctatcgggtcggaaaaaatcgggtaaatcttgccagtaatgttttggaagaccgtttgaagacgacgttcgtccagcttgcgctcaggattagcaggttgcgttaatttgaaagttgcattgggaatctctgccagcaatcgcacattatcgacataatctttatccttcagaaacccggtaataatcattttggattggctggaaaatgaatgtttcacggattcagcgaaagctgtgatcgcatcaacattatgagcaccatcgatgatgatcgtcggttgagcgtgaatggtttcaaaccgtccggggacatccagcttccccagcgcttgggttaataattgactggcgtccagtgataagtgctgctttttttgaaaatcatccaaccacaacaacacggttcggacattttccaactggtaatcgcccggcagtccaaattgaaaatgaccagattgatgaccgacttgataaacgaaatgagttgctttagttgactgccgatcaatttgaactgtgttggcatcaaggaagttggcggctttgtgactcgcttcacctttcaagactgccaggacttccggccgttggttgggggccacaatggttgtgtttcctggtcgaataatttttgactttgtcgtcgcaatttcttcaatggtatttcccagaatgccaatatgatccatgccaattttagtaaagattgaatacatggttgttttcactgcattggttgcgtcgagctccccacccagaccgcattccaaaaccacatagtcaacttgttgatcagaaaagtactgcatggccgcaacaaacatagcctcaaattcagagagttcctgctgtccatcaccaaatgaagtcatcagctgcttgaggcgattgagatacttatcaaattgatcagtttggattgcctggcgattaatctgaatactattggtaacatcaccgataaacgggctggtaaataaaccaactcgttttcccatctgctggagtattgcggcaatcatcgttgccgttgaccccttgccgttggtaccgcagatatggatgattggatagtcagcatccgggttgcccaattggcgcagaacttgctttaacaaaccaatgcgatcaccttgattatataaaaattcggcaaagtgactggttaaatcatcgttcatatttgtcccacctggattgaattcaaaaactcacttctcagctcatcgttttgctggaagacaccggtaaatttagtggttcgggtcacggtgccggtttttttgacgccccgcatttcgatacacatatggcgggcatcaacaattaccgccacgcctttgggatggagaattttttccatttggctgagaacatcatccgtaattttttcctgcagacttaacttgtgtgatacaaaatcaaccagtcgcaggattttacttagaccgataattttcccgttatcaggaacataggcgacactgactttgccccagaatggcatcatgtgatgctcacacatcgaataaaatggaatccctttcaccataaccgtctttgagtcatctgactccggtgaatcaaacagtttatagtcttgaaaatcttccagtccgatagaatcaaagatgttggcatacattctggcaacccgatccggggtttcaataagtccctttctagtcgggtcgtcaccaattgcagccaatatgttagtaacgttattggtgatttcggtgtagaagttattagccggactgatttttttgattgattgatcatcttgttggagagacttaatggccgtggcaatcttatcagcgtctggaaattgtccatcaatcaattcttgaatcggaatcaacacaaataatcgattaaacgcttcgggatgtggaatcgacagccctggttgatcaatttgttcattgccaaagaagataatatcaatatccacggtccttggaccccagtgaacctggcgagttcgatggagaccactttcgatttcatgaatcacctttaagagtgccaggggttcataggtcgtcccaatcttgacagctgtgttgacaaatgcccgttgcttgaccccaccaaccggggacgtttcgtacagactggcctgcttttcaatcataatccgtgggtcactacccaatgcctcgatggcctgttgcaaaaatgcctcgcggttcccaatattactgcctaaacttaaatatacatcttccatactaatgctccatttctatttcgacgtcgtccaaaacaccatcaatcggcgttccttgtttgcggatccggacattgacagtcataatccgcgaatcaatatttttaatagcggcaatcactgtctgggccaaggtctcaactaagtcgacctgattattgtcgatcaccttggcgatggttggatagaaatccgcgtatgacaccgtcgacttcaaatcatcatcagtcggatcggcatcgactttcacttttaaatcaatttgaatattttgaccaacgactttttcctcgggcaaaacgccaatatgactgtgaaaccgcatgttgtgtaatgagatgtaatacatcatgattcactcctttgtatacgacaaaaagcggcccgccgaccaatatgttggtacggtgcgtcgcttctcattttatttaaacaaccgactctgaatattactcattgtctgggaattcagcatatagtaaagaattgccatttgaatcggtgtcatgaccaattcttttaacgctctaaccggtaaaaatgcccaaaacggtgtcttatataaaattgtcaaccaataggtattcaaaattgcgttgacgacaaccgcaatgattaattgggcaatgatcacgcgtttccatgtgatctctttgccatagaaaaaatagccataaatggcagcgcctaaaattgcagagatagtaaacccagggaaataaacacttccagacatcaaagtgccgatgatatccgttaatgcagcgattgtggatgaccacagtggcccatacagcatactggcaatcgcagtgacaacgaagccgaagcttaaccgccaggactgaacaccgacagtaaatcgaccgagaattaacaataacgacatgaaaattcccaagacaacaatatccacaacccgcagcttacgaaaacccaatgacaatgacttcatgatgcagcatctccttataaaggagctcaccattatttagagaactaaataacatagcgaatgcggaaacaacaccgcaaatggtcgacaagtcgaagtcgatcatttttcgttcgaagttcacattccgttcctccgacacttaacgcattgaatcctaccccatatttattttatgtaactattaaagtttatcacatgcactaaaaaatgcaatcgcttagttcgtgttttactgaacaataagcgattgcaagttaaaatagttcattttaaatgttatcctgatcaaagtctcgaagccacgcaagagctaatgctttgtcgcctaaatgggtaccaatggtgggaccaaaataactttgttcgattgtcatatcaggataaagttcgtgaattttatttgcccattcatttccggctttaggatcattgccgttaatgaccaatgcccgcagaggataatcagctttttgtttggcagcagcaaagagttcctccactcgtttgagggcttttttacgcgaccggatcttttcaaaggcgacaatttcattacttttatcatcaaatgtcaataacggtttaattttaagaattccgccaatgaatgccgaggcgtttgaaaggcggcctccgcgaaccaggttttgcagatcatcaacgacaaacagttcgtcaattgtctgccgaagcccatcaagatatgtaaggatctggtcgggcgtgcgcccaagtcgtgccattttgctggcttggatggccatatagcccattaacttaacggtgattttggaatcatatgggatgactttgatcccttcgatcgttggtgcaatttgagtcagagaactatagaagccagaaatcgtgctggcaagatgaatactaatcacggtgtcatagccttgtttagccaaagaattgtagagatcaatcatctcaccgattggcggctgagatgtactgggaaaggcctgagaattctttaacttatcgtagaattctgccgtcgtcaaatcgacaccttccttgtactcacggccatcgataataacagggattggcacttcgataatgttgtatttcgcttgttcttccttggttaaatacgccgtgctatcagtcacgatcgcaattttcattaaattcacctgctcgtaattaaattctatccaaactcttttcaagacgattgatcaatatctttaaaagatttttctcttcatcagtccaatgattaaatacccggtcagtcagcttttgaatttcggcggcaacatattgactggcctgagttcccttgtcagtcaccttataaatcaattgtcgcttgtcccgaccaaccgcggtcttttcgatcatatctttttctaatagtcgcttcaactgccgcgacaaggttgaaatatccaatttggtactttcggacaataattcctgggtggtattgccggcaatgacttgatttaacaacttccattcagaaattgtcaggttcattgccttagtaatattgaatatttgagatcgatgatttttggcagcagaattaagtgccacaagaatatctttcatgatgaaaagacctccgaaaaattagtatacgctatttgataatgacatacaaataacatgtgccttccttagcatcagtcaagaaagtgcgctatactagtacatgctacttatacgaaagtgagtgataagatgtcatttgatggttcttttacccattctatgaaaaatgaattaaccgatctgctgcaaacgggtcggatcagcaaaattaatcaaccctatccgaatgaactcatattaacaatccgagctcacggaaagaatcaacagctgctgctgtctgccaacccgacgtatgcccgggtacagattaccaaagttccatatgtcaaccccagtgtgccgacaaactttacaatgattgtccgtaagcatctcagcggtggaattctcagtgatatttcccaacaggaaaatgatcgcgtgttgacgttcaccttcacggcgcgcaatgaactgggtgaccagacaaaattagatctgattgtcgaaattatggcccgtcatagtaacatcatcctggttgagcaagccacgggaaaaattattgacgctattaaacacgttggttctgacgttaaccgatatcgcttgttgctgcctggagcaacttatatcaaaccgccgaagcaggacttggaaaacccatttacgatgactgactttgaccgggtccgccaattgatcaaagattttccaaacgtggacgttttagctgaaaatctgcggaaaacaatgcaaggattgggcaacgacacatctttggcattagcaactagtttgcataaggacgagaaagttgagactaatttcaaggatttcttccaaaaattcgactcaccagagccaacctttagccatgttgcaggtaacaagattaattttaccgcatttccctatccgggtacaactaaaaatcaaactttctcaacattgagcgaattgctggatgctttttacgccagcaaagcccaaagagaccgggtcagagaacaaggcgcggtgctgattcaagtcgttaaaaaacagcttaaaaagaatcgcacgaaacttaagaaactccagcgggatatgaaagaaactgaaaatgcggatgattatcgggtcaagggagagattttaacaacttatctcaacaaagttcaacgtggaatgaccagcattgaactgcccaactactatgatgaaaataaattgattaccattcagctttccaatcaacaatccccttcccaaaacgcccaacgatatttcaagaaataccaaaaattgaagaacgctgttaaatttgttggcgaacaaattcaactgaccaagcaggaggttgattacttcgaaaatattcaatcccaaattgaactggctgatccccaagacctgatcgacatcaagtacgaattggaacaaggtcattatctccgtgatcatgagcagaacaaaaagaagaaaaataagcgacaaaagattaacaaaccagaaaagtttgtcgcaagtgatgggacagaaattttagtcggtaagaataatctgcagaatgaaaaattaactatgcataccgccgacaaacgtgatacctggctgcataccaaaaatattcctggatcacacgtcattatccgcagctttgacccgtctgagaaaaccctggcggaagctgccaatctagctgcctatttctcgaaagcgcgcggatccgccaaagtacaagtcgattacacaaaagtcaaaaatattcgcaaacccaatggtactaaaccggggtatgtgatttatgacaatcaaacgacattgttcgtcaccccggatgaaaatctaattgatcagatgcgaaaataagcgggtgagtaatctgctttcaatttctggcatacaaaaaatgcgcgccatagatatacatcagttgcatttaggagcgtctttctcacattgtcagtcacactatttagcttgataatatgtagaatacacaaagggtcggggcaaaatatcaacttttgccccgacctttttgttgtaatcttattcaaaattcttaaatgatagtgatgaaccgacttcttgcttagtggttccctcagtgcgactggattggagttctctgaaggggaaatgagcagtcataatcgatgcacgtttgtgctccgttggcttcaagtcttcccgcaaggcttccatatccaatgtgtgcaggtatttacggaccaaaacgttaatccaattaatcccggtcgttttggtgagaaaggcggtctcagtaattcgtacaggccgaatgccggtcatctcatatttagaatcaccagttgtattatacaagacttgaaccagcccctgccattcttttggatctaccttgttagtggcatcggcaatcaattttgcttcgtcagacttccagttatccatcggttctttatagtcgttaataaaccgcaggtcagtccgttgatctttccccacaaaagaaatggtcgtaactggtaaaatttcatcgccttcgatgaacagatcgacagctgttgtcgcatacttttgattgtatgtggcaactttttgatccggcggcaaaacgatgatattaagattttgaaattgttttaactgtttagacaagtagtgtcggttccctgggagaatgacgacatctggtttctccaaattaataatgttgagaatatttccgagttggatcggctcaatgtattgtttgtcacttaactgtggcgttagtgagacggcattcggatttgtgttcatgataattgttttatagcctgacttgtgaagcgccctgagaatctgtgaggtgtaataatccgctgccgaattggggccgagttggttcccaccccgaccaatcaccaaagcactcttttcttcaaatggccggctttcattttccaattcataactgctgtaaaaaatattggttgattccagcatctcaccggcgctcggctcaactgccttgtaagtgacgtgattctggtagttttcgttcaactgctgaatctttgaaatgttgacttgccataattcagccagcatgccgtcaccaaaaccgtatttgtgtccaatttcaatggattgcggtgacattgggttattgacaacaaaatcctgagctctcaataattgattcaacttgtagaaatagaaacgatcaatttgagtcagttcagatagctcatcaattgaaaagcctcgccgcaatgcctccatcaaaattaatattcgactggccaatggatgaatgagttgattaatgacctcgtcatcattaaccgtcgacacgctgggcaaaatatcccgtggtgagaactgggaactatgcatggatttaataatcgcttcttccactgtccggccaattccaatggtagatccaaccgatttcattaaagtgttcaaatgctggtcaacgtccgtaatgtctctaaacggccataatggaatcttaacgaccacatgatccatggttggctccatgaacggcagaaacttgttatatttactcggtaacttgatttcagtcagattgtaccccatttcaagaaagcttgagacgtacgttaaggggtacccagttgctttagcagccaagatggtgtttctggtaaagaacggactcaccttggtcacaaaataattggcatcggttctagactgggcgaattgaacgtgacaagttcccgtcacattcagagcatccataatgcgaaaagttgccgatctgagcgcttgatattcttcattaatcaaagtctgcgttggtgcaaaaatgattgaatccccagaatgaatcccaattggatccatatcttccattcccgaaaccagcagcttattgccgctttcatcgcggataccgaccatttcaatttccttgtaacccacaatactctgttcaatcgagcagcgcttaatgtaggttcgcttgaaactcacatccaaagcatcttctaattcgtcagtattattacaaataaaccgactggtatcatgacttgatgacatcggtttgacaatcactgggaaaccaacctcacggacaaagtccatggcttcgtcgtcatcggccacaattttcgaggcaatgactctttcattaatttcggttaaagtatcacgaagtttctgattgtccataaccttccgcaaatcagccggtttgatgcccaagagtgaaatgttgttagaggccaaaatgccactttcagccagctgccaagcaatttgcatgccgttaagtccgccagtggttgccataatggcgtccggattttctttatcaataatgttgacgatattttgaaaattggcctcttgaacatacacgttagctggttgaatttcttcagtagtaacggaaaatggattgttatccacataaattattttcgcaccggtttttttgagcgccatcaagcgttcaaaagcggctgcatcaagttcattttcatggccaatgttggttgggccaccgccaagcaggaggaccttgttaatatctatcgtcattgctgtcccttcttcttgccatgatttccataaagtcgtcgaacaagccaacactgtctttgggccctggtgccccatctggagaaaattgaaccgaaaatgcggggtaatctctgtgccgtaagccctgaacagtgccattcaccaaatcgatatgggtgataaacagtttggcatggtcaattgattttggatcaactgcatacccctgttcttgacctgagaaaaagatctcattggtgataatttcccgaatgggatgattactgccgtgatgctcaacggttagttgggaaactttagcaccattggcaagcgcaaacagttcatggcctaagcccatcgcaaacaatggcgcctgcgactgaacctctgtaatcatgtctaatacagactttggtaaattctccggcgaacctggaccagtcgataaaacaatgccatccggatccaaatccaaaatttgggcggcggaaaagttccaagggaccaccgtcacgttacagtcacgatgggataactcccttaaaatgccgctttttaagccaaaatcgactacgaccacgttggcgccttcatcagggttgggaaacggcttgggagttgccacttgagcaacttgttgatttgtcaaaaccgtcgcgtgcagctgatcaaaagcatgatcatccgcgacgtcgacaatgcttgctttcatattgccgcgcttctgtagatgatgtctgatttctcgggtgtcgacgtcataaattccggggattttgtgttgttttaaatatttatccaaagaaatccgcttaaagtggtcagttgccagattttcgtactccctgacaatgacaccttttgcggacggcaaaatggactcgtacgcattctggtcgagtccggtattccctatagatgattgggtaaaaacgataatctgattatggtaaatctgatttgagataatctcttgataaccgttcattgttgaattggcaacaatttcacccgtcgttgttgccagtgatccgaatgcctttccagcatacgcggatccatcttctaaaattaaatatctttccgtcatgctgactcctcgcaatgagaattatttgatgagttcaacagcatccttgtcatcaatttctgaaacataaaccttaatcttttccttttgagaacttgggatattcttgccgacaaaatcggcccgaattggtaattcgcggtgtccacggtcaaccaaaactgccagattgatactcttgggacgacccaagtccatgaccgcggaaagggcagcccgaacagttcggcccgtgtataaaacatcatctaccaaaataacccgtttaccttcgatagaaaagttaatcttgttattggacattttgacatcactgctcatggcatcgtgttcgatatcatcacggtagttggtaatatccaattcaccgacaggaatcgaaacattttccaattgttggagccgatcggcaattcggtttgccaaaaagattcctcgggtcttgataccaattaagactaaatcttcaacacccttgtttttttcaacgatttcatacgtaattctcgttaaggcccgctgcatagccattttatctagtattatctttcccattagtaaaagctccttaattgagtaacgtttgtacctgatgattgcataaaaatgctataccacttcagaatatgaaaacagcgccggattgtcaagatccaagagcgttgtttaatcgtaaattattaagtgtttgttcaaatattggtggcaggggcgccgaaaagatcatcaattgatgcgtccgggggtgttcaaatcccaactcctgggcgtgcagaaactgtccattgccacgaatggtttttcttggcccatataaaggatccccaacgatcggatgcccgatgtatttcatatgaactcgaatctggtgggttctaccggtttccagtcggcaggcaaccaaagtgtagtcagcaaatcgctccaacacctcaaaatgcgtcacggcacttctgccgtccgaaacaactgcctgcttttttcgatcctttggtgaccggccaatgggcgcgttgacgactcctgaatcttccttaatgcgtccatggacgagagcaacatattttcgcagatttttttgggcttgcaactgctgtgacaaaaactgatgtgctttgtcatttttggcaaccatcaacaatcctgaagtatccttatcgattcggtgaacaatgcccggccgaaactcgccattaatcgttgacagcgggctatggtacaacagagcgtttactaacgtatggtccggatgacccggggaaggatgaaccaccatcccctgtggtttattgacgacaatcacatcatcatcttcataaacaatatcaagtggcatgttctccggttcaagactgatcggagtcggttgcaccgaatcgacctgaattttatcccccgacttaacttgatactttggtttgactggctcaccattgattttgagatgttgatcgtcaattaaattttttgcccgtgaccggctgattgaagaatcaagttccgagatgactttatccaaacgtccagtctggttggtaataatatactctttcaaaataattgttccccttaatcaactttcacggatgattgcaatggccaaaatcaaaattccaaacgtcaagtacatgtcagcacagttaaaaatcggaaaattgataaagtcgagttgaaatatgtcgaccacgtgattgttcatgatgcgatcaatgacgttccccagcgtaccggctagcaacagccccagaccaattcgatacggcatatttgaccagtacctcacaataaagtaagtcactaagattgccgctaaaatcgcgatgatcacgaaaataaattggtggccggataaaatgctccaagcagccccggtattgttaattctggtaatcgacaaaacaccgttgatcacagaaaatgaatcacctaatgccaaactggcaaccaccaagtgtttaacaatctgatcaatcgcaattaaggcaatgattccgataacataaagtactggcaaaataaacgctccctttagaacagcccggtaatccgaccctgttcatcaatatccatgtcgagtgctgcaggatgagtcggcagccctggcatggttaaaatttttccggttaaggcgacgatgaagccggcccccagttttagttgcagatctgaaacatggattttgaaattctcaggtgccccaagctgcttggcgtcatcagtaaatgaatactgggttttcgccatgcagacaggtaattgatcgtaacccaactttttaattcgctttaaagcagttttggctttatttgaaaattcaatcccatcacccccataaatttgggtgacgattttggccattttgtcctctattgaatcatcatcgctatataattcgtggaattcggctggccgttcacaagcttcaatgacatccttggcaaggtcgactgcccctttaccaccttcagcccagctgttgatgatcgtcccagtaaccttcaaatcattggtgacatagttttgtaaataagttaattcgtcttcggtatcagtggcaaacttattaattgcgacaaccaccggtttgccgtactgctgcatcccttcaacgtgacgtttcaaattgacaacgccttttttaagggcctcaagattttctgtgttcaattcatgcttatcagcaccgccattcagcttcaacgcacgaactgtggcaacgactacgacgcaatcaggactctgcttcagccgtggggtgacaatatccatgaatttttcagcacccaaatcggacccgaaaccagcctcagtgatcgcataatcaccaaaatgcaaagccgcttgggtcgccaagatactgttacagccatgggcaatattggcaaacggaccgccgtggataaatgctggtgtatgttcgatggtttggaccaggttgggtttaatcgcatctttaagcaataaagtgagtgctccttgaacgtgcaaatcagccacggtcactggttgccggtcgtaagtatagccaatcaacatccgactgatccgttgcttcaggtcaggcagactggttgccaggcacaaaatggccatcaactcactggcaacagtaatatcaaaaccatcttgacgcggcacaccggaggttctcccaccaagaccgatgacgacctggcgcaattcccgatcgttgacgtccatcacccgtttccaagtaatttggcgcggatcaatgtttaattgattgccgtgctgaatatggttgtcgattaaggcggctaatgtgttattagcctcagtcaaagcatcaaagtccccggtgaaatgcagattgatatcatccattgggacaacttgagcgtagccgccgccggttgcgccgcctttcatacccatgaccggtcccagagatggttcccgcaatgccagaaccacctttttatgtaattcgttgaaagcatctcccaatccaactgttacggtggttttaccctcgccggcagcagttggattgatcgaagtaactaaaataagcttgccatttgccttttcagtggttgggtcaaaattgatttttgctttatactgaccatattgttcaatttggtcttcagcaatcccaattttttcagctatcttggtaattggttccataacagtttcttgagaaatttcaacatcgctcttcataatgattatgaccctcctaaataactatcgactgacaacggagcagcaattatttgttggaaatcaattctttgatctcaataacggagttggcgggtaaaatgaagctgtagatcttggtgttggcgacaaaggccagttggtatttcgaggtctgaacgtgtgaaatctggtccagatcaacggttaaccagtgaggattcgtgatgcgactgacgacaaatttgtgatcgtagacgtgaatactgcgaaaatgaatttccgcccagacaatcacggcaaacaacacaaagaaaaataacgtaatccactgaaaatgagtaatttccagccagataatcacgccaatgaaaaagacgacaaaagtccaactccaacaaataatactgctcaatgggcttggttgataaaagaagtgacgcttttggcttatcataaataaactccttaaagaaagtgtagataacatgattaaactatatacagacgcagccgtcaatcagcataccggacacaccgccatcggcattctcattgtcaacaatggcaaacaaattcaacttaatcaagtgattacgccaacggacaatcatgatgcagagtttagcgcagcaattgccggattccaaaaattgatcgacttacaaattaatcccagcgaactgatttttttctatactgacagcaaaatcgtcattgacagtctcaataaacaatatgccaaacatttcgaaaaacatctggacaaactactgggactgcaaaatcaattcgcaacggtggtcaacacctggattccagacaaacaaaacatgggcgcgcatacactggcacttcaagcactgcattcaatctagtcaatatactggctgaccggctttgtgtaatcctgccaatgatcgatttcccgttcaaacactgcctgagcaagaagatagccaatcatcggtccggtagttaaacctgaagaccccagaccgccaccaatcaaaaagttgggcaatgtcgggactgctccaaagaaaggcgcaaaatcttccgtgtaggctctggtgccgacccgcatgtcacttacttgggcgtccgttagcgtgttgataaatactttggcattgttgagtaactgtcggcgagcagctggctgaggcgttaaatcgaatccctcgtcattctcgtgagtcgcaccaatcaccaatttaccgccattgaacgggataacgtcactactgccctctggcatcataactggcatatttcgccatttatggggcatcttgacagttaaatcgattaattgtcctttctgcggccggaccttcacgttcaaccccaatggccgaagcgactcatgcatccaagcaccggtggcaataatcacaatatcaaaatgtttgggccccgctgtcgtgttaatggcgccattagccgtcaaggaaacccgttcatttttgacatccaggttattggcagccgcccgttccagcagctcggaaacaaagtggccgccgtcaatccgtgcgccaccactgacaaaaacaccttccggagcatcggtgagcaacggcatccggcgttttacctctttggcgtccagcaattcgacccggcccatcgcagttgtatgctgctctttgatcttggcctcctgataaagcgccaataagtcaccgtggttcttgcgagtcacgatcgtacctgtctgctgataggcttggttgctcaactgagcgtcagaaacgagggatgggtataattctgcaccacgtttggccaaagcgtaccagcgcttatttctgcgctttgagagccatggcgagatgatgccggaggctgccttcgtggcttgccccgtgtcgtcgtcaaatagtgtcacttgaatattgtcattaccttgtagaaagctcaaataaaatgcggctgttgcaccaataattccgccgccaattatcgcgacttgtttaaccatttacccacttcttttcaccaagttgttcttattttagcatatattccggcttatttgctcttaatttggtctaatttacgtaaatctcgaactttctttccccagaactgaaaatagtccgtccttattgatccgttgtagagctttcgtcgtttggttgctttttccccataatacttttcaaagtcaaggtccgaggttaaaaagtattttgaccaactcgtgagcggattgaagactttccccatttgtttgtataactcatgggcatgttcttcgtcactcattcgttgtccatagggtggattgccgacaatcacgccgttgaccttatcagttttgaaatcggcaactgccaattgtttaaactgaatatcagccagcaggccggcctcttcggcatttcgtttggaaatttcgatcatattgccgtcaatatcgctggcagaaatatcaagttcaatgtcatagtcagccttcgaatctgcctcatcgcgaactttttgggccatatcatgatcaatccaaggccactgctcacagatgaagtcacgattaaagcctggagcaatgttgcggccgatcatggctgcctcgattggaatcgttcccgaaccacaaaacggatctagaaatggcatgtcgggataccagctggttaacatcaccagggcggcagccatgttttccttaaggggagcagaccctttttcgattcgatagccacgtttgaagaggcttgaaccggtggtgtccatggtcagcatcacatgatccttattaattgccacttccagtggaaattcggcaccggtttctggtaaccgggtgtggcgatgataggcagtgctcaattcattgacaatcgcttttttgacaattgcttgagaatcaggaacgctgtgcaattttgagtttcgcgaacggccctcaactggaaaggcggcatccattggcaacaacttgtcccaggcaattgcagtcgtttgttcaaacaattcatcaaacgtttgggcgtcaaattcatcaacaacaattttgatccgatctgccgttctcaaccacagattggttttaataatatcttcttcattaccggtgaatcggacccgaccattttcgacctggacgtcatatcccaagtcacgcatttctttgccaactaaggcttcgataccggcggcacaagtagccattaaattaaatttcattttatctatctcctgcattttctgggtaacaaaaaagtgggagcaagctcccactcaacctgtttggtgtaaatccctataagccatgttttgtgcttattatatcccaggacgacataacaagtagtaatcatctatctgagaaatatcgaaatacttctcccccacacttggttcatttaccgtgtgtgaagctcccctaccaaaagtttgggtttcccgctcgaggggtttaccgcgttccatcagtaccgtttccaatactgttcgtcactgtggcaccttagggaattaaagcatagcaagccttagctttaatatccgccgtaactcacaaagagtcccccggcttattttttcaccgagcacgaacactacgggcatcgcagcccgtgcgagaatggactttcctcagccgtaatgatacgaccgcaattactcaggatttacaccatattagttatatgcaagctttaaagcctgtgtgaatcattggtattattatcaagttgtgatccgaatactcgtctttcaaggttggaaaggcgctttaaaatgtccatattagtcgcacttgacattggctgactcggaacacttctggttggagcagtgccaccagctgatggcattggctgcgaaccggataccgcaatctgcttattcaattcatcgacttgaacttttaatcgctcattctcatcactgagggactggagttctttgttgaaagtttcataatccttgatgatgtcgtctaaaaagccgtcaacatcattgggatcatagccacgcatcttttgcttgaattccttttgaagaatatccttcggagtataattaatgttttccatgtatgggttacacctcactatttgcaacaaaccaactaaaataatatcataaattagtcatcttgaacactattattcaagttttcctgatattcatccgcagcactctgtaaatcgtcgaaagtaattagcttatacggatatggatggttgtcagcaaatctttttatttgatcataatcgtattgcgatttccctggattatctaaatcatatatcaataatgcctgatcggtatgactcagcatgaattcttggtaatttcttaactgttggggcgactgatacggcttttgagaaactgacgccgaaaaatcgacccgtgcctttagcgtctgcagcttggtttgattgttttcgttccaattactgccgaagtcagcgaacggcagcatcattgacgtctgaaattcgtctggataggtctttttcaaattcagggccatttccaacgaccactgctcaattcccaactgtccgccggaaattaaccaatccatgccgtcaacaattgcctgatcaatttcattttttaagaccaaatcaatgacttttcgttttggatcgtcatctttaaaaattcctaattcatagcttcgatagccggttacccacaagcggctcatgatatcaccctaacgattaaatattttaaatgaagactctacttggtataataacattattgtggttattattaagttaaatgaagtacaatataactattcacaaaaaggaagctaacgttcaatgactatcagatacccgaatggaaaccagtttcatgagcagccgacttcttccggtacccacaatgattcgattaacttctcaaatcgaggaatgaccttggaggacgaaatcaacaagagcaatcagtattatcttcgtgcaggaattgcagttattcataagaagccgactccaattcagatcgtttctgttgactatcccaagagaagtgccgccagaattaaggaagcttattttcgtcgtgcttccactacagattataatggcgtatatcgcggaaaatacattgactttgatgcaaaagagaccaagaataaacagtctttcccactcaaaaattttcatgaacatcaagttgaacatatgcgacaatgcttacaacagcaaggaatctgctttgcgattatcaaattcatttcggatcaggccgtgtttgttttgaaagccaccgacctgattacctattgggacgcccaaaaaagtggcggtcgcaaatccattcccagaaaagtcattgaaaaggaaggctttttgattcaatacagaattaacccattactaccctatcttcgcgcggttgattctttcatcgaataagttacgaaggagaaggctatgtcacagaacaatccgaaaaactcacgcgctgaagttcggcgcggacgacagtttagcaatacccataaaaaaggcccctttcggcgaatcttcaaatgggctttaatcctggttggtgtcctatttctgtttggcgccggcctattcacgtactacgcttccagtgcaccacgaatcacccggtctgcgctgaccagtgataactccactaaattctatgatgccaacggcacagtaatttcacgtctgggaagccagaatcgggactacgtcaaatctaaaaacattccaagaaccctcaaacgggccgtcgtttccattgaagatcggcgtttctataaacaccatggcgttgaccccatccgaatcgccggagcagccatctcgaatttgaccggatcttctttaggtcttcagggtggaagtaccctcactcagcagttagtcaaactgtcggtcttttcaacggctgccagtgatcgaacctttaagcgaaaggctcaggaagcttggctggcaatcaaagttgaaaatcattacagtaagagtcaaattttggaattttacatcaacaaggtctatatgggcaacggcgtctatggcatgcagacggcggcagaatattattacgataagacgcttaatcacttaacgttacctgagttcgctttattggcaggtatgccacagtcacctacgctctacaacccttataagtatcctcagtatgcgactaaacggcgaaatgaagtccttgatgcgatggtcaaaaccaaagacattactgaatcgcaagcccaagctgccaaaaataccagtgtcaaagcccatctttcagcgacccacgcgaaggcgcgaacctctgaaaagacttctaaatacattgattcttatttaaagcagaccatcgaagaactcgaggacaaaggctacaaaccaaatagcggcctaaaagtttacaccaatttggacatgagtgcgcaaaagaaactttatcaggtaagtaataacgatccgaccattgcctaccccaacaaccgtttccaagtcggcgcaaccattgtcgatgtcaataatggtaaagtcgttgccatgcagggcggccgcaaaaccaaagtggcgttcggtttgaacagggctgtccaaaccggcaggtcttctggatcaacagctaaaccaattatggattacggtccagccattcaatatcttaaatacccgacctaccagccggtcaaagatacgccgtacgtttatcctggaaccgacaaatcggtctatgactttgataacaaataccaaggcacgatcacgatgcgaaaagcactggttgagtcgcgaaatatcccggcaattcgaacacttgaaaatgttggggttcctaaagcaaccggctttttgaaaaacctggggatgtcgtttagcaaaccactcgagattcaaaatgggattgggctctacatttcctctgaacagctggccgcatcttacgcagccttcgcgaatggcggaacctattacaaaccgtacttaatcaacaagattgttcaagttaacggtgtgacccacaagtatcaccagcaaggcaaacgcgccatgtcgccggcgaccgcatttatgatcactaatatgctcaagggcgtgatgacagattctgcaggttccgggactgcagccaaggtggctggtctttatgaagccggtaaaactggtacgacacagtatcccgacgattatttgaacaaagtgccggcgatgtcgacgatggattcctggttctccggttataccaagaactattcattagccatctggactggatacgaccatcaattcaaagcaaattcctatgtcacctcggcacaaacatcgatcgcccaggaaatctataaaaacgtgatgggctatatttctgaagataaacccaacaccgattgggcccagccaagtgacgttgtcgcaaccaaccgtggcgggaccactgagtattatgttgccggttatcctgggacagtcaccgataatagttcaaatcaaacgaccagtggctacacaactgaaggtggttcaagttccagctcggcagttgtcacgcaaccacgggaaaatgagagttccagcagtacagaaagttccaacgagtcatccgcatcaacgccatctgagcaaaaaccgagtggcgatggtggtaacgatgattcaaacagtagtgccgcatcatcgagttccactgacaatggcggtacgacgccagacaatggtggcggcaataccaataacaatgacaataacggtggtactgacgaaacccaataaaatcagcacagtccatcagagactttcgacaaacacatcatttgtcgagggtctcttttcgtttaccaatatttcctgtggacttccttatcacgggtttctgaatgccacattgaagaaccgattgtccctttgactatgtacgaaaaaatcggctaaaagtttagccgatttcctaattgtttatttatctgaattacctgacaagttgataaacggaatttccggaccgtcgtaaccggttgaaatatcatccgaatgtggactattccggttctttttggcggcttcaacttgttgtggggtctttaaatttttcttgtaccaagtactaatgattcggtccatataatttaaattataaacctgacttaaaacggcttccttcaacgccagctgaattaattccggtgaataatgatcaatatccaaccactgactgatagactccatctcaatcggcgacaaagttcgaccaaattcttgttcaatactttgaaagactgcttggcggtcggtgctgctgacagtcttgggcttttcgtttgccgacgcctcaggagaggttcccgtgggcttgaccaatgccaatttttcatacatcggcgtgaaatcgtaggcatcgacctgctgaccttcaatcactacttgcgtaattttggtcagcttcttttcaatcatttgatgaaataaattgaacagctgctgttcagaataattcgtctgggcttgcagatctgccatttccggcattggaactaccaggtcatgatttcccttaatcagcaggtaaatgaaaagctcctgattggtaattccaatctgatgataatgttttaacaggtagttgctgacagtagtttgcccctcatttagtagattgcgtgcataatcttccatccaattcacctcgaatccaccaaaccagtgtttaatttcaatttatgggtaaattcggttaagcagtcttgggaatggaattgcctcacgaacgtggtcttcacctgttaaccaggtcaaagcccgttcaagtcccaagccaaagccggaatgcggcacactgccgtatttacgcaaatccaagtaccatgagtattctttaggatccaaaccagccttgacaatttgatcatagagatagtcgtaatctgttgctctttctgaaccaccgataatttctccatatccttcgggtgccaagagatcagcacaaatcaccacgtcatcacgagttggatgtggcttcatataaaacggtttaattgctttagggtagttgatcacaaagaccggttggttaaattgatcagcaaggtaggtttcttcaggagaaccaaagtcgactccccactccaaatcaaagccaccctttttgagcatcgtaatggcttcatcataactgattcgtggataaggtaaaacagtgtacttcttgagaacttctgggtcgcgtcccagtgtcttcagttccatttggcaattttcaagcactcgagtcaccaagtaagcaatataacgctcttggatttcaagactctcttcttgatgcatgaatgccatttccggttcaatcatccaaaactcgatcaaatgacgacgggtttttgatttttcagctctaaaggtagggccaaatgagaacactttgccaaacgcttcggcaccggcttcttcatacaactgaccactttgagacaaataagcgtcgcgatcgaagtattccgtatggaaaagcgtcgttgtcccttcaggcgcacttccagtcaggatgggcgcatcgattttgatgaaaccttcatcgttaaagaaatcataagtcgccttaatgacctcattacgaatccgcataacagcgtggggccggctggatctcagccaaagatgacgatgatccattaagaagtcaacaccatgttccttgggcgtaattggatagtcatgggtttcagaaaggacctcgatggtttcaatttcgatctcgtagccaaatttggaacgagcatcttcatgaatgatcccggttacccacatgctggtttcctgcttgacttccttcgccaactcgaaaacttccggggtaacattactcttcacgacgacgccttggaaaaatgccgttccgtcacgtaattgcagaaaggcgatcttaccacttgaacgtttgttggttaaccaaacaccaattttaactttttcgttaacgtacttaggtgcgtcaaccatgttaatttgtttcaattccgattcctccagatacttgtttttctaaaaactgattcataaattcagtgatccgctcaacggcggttaccaggtcttccaaactagtggcataactcaacctgaggtagccgggcatgccaaaagcagctccgtcaaccaccgcaacgtgggctttggccagcagctgatcgaccaattcccctgagtcattaagacctgccaggtcaacagccgcttcaacatttgggaataaataaaacgccccttgcggtttagctgccaacttaaaccccggaatttgttgcaccagcggataaatttgatttaaccgttgttcaaaggcctctcgcattgtctcaacggctgattggtccgactgaaaggcagcaatcgcggcatattgacttaccgtagctggattaccggttgaatgagatagaatcgaatttaccttgccgattaattccggcgccccggctaaatagccaattcgccaccccgtcatggaataggctttggaaacgccgttgaccaaaacagttgaagcagcaacctcatcgctgatttgaaccaatgaaacgaactggttttgattatagaccaatttgccataaatatcgtcagcgattaaggtcacattatgcaagaccgcccattgaccaattgccgccagttcatccctggaatacacggttccagtggggttttgcggtgaattgatcaccaataccttagcatttttagttacagctgcatccaagctttgagtggtaatcttgaagtccgtccccgtctcaacaatcaccggcttgccacctgcaagattgacctgctggcggtaactgacccagcttggccgtggcagcaagacttccgtgccgtcatcgaccaatacctgcattaacacgtacagtgccatcttggcaccgttggtcacactaatttgatcagctgggtagacaacgccgtagtcctccttaatgcgttcggcgatggcttcttttaaatgaggtaaaccactggccggggtgtaaaaactggttttgcccgatcgaatagcgtcaattgctgcatcggcaatgatttttggggttggaaaatcgggctcaccgatgcccaaattaatgacatcgatgccctttctgatcatcgccttggcagtattggaaactttgacggttgctgaaggcgtgacctgcatcgcccgttttgaaaatttcattgaagtgtcctttcatttctagatgttttcaatcgatttgtaaatggtgccgtttttgaagctgattgtcgtaaagcacaaatgattcttggcgttcatatagctgaccacccagtatggctggttcttaatcatcgtcaggccaatcccgtttaattttgatgggtgtttttgccgttgaatcacatttttggcctgctgctcgctaataccgctgctgctattgataacgttgaccgtgccgccttttttagcgacgatgacgtaaacatttttgttcttgttatcaacaccggaaacggaataataagtcttccccaaattagaggtgtaaaacgagtcgactttcgttaacccggcgtactttttagcaatcgtttcggtctggccgcgggcaattgtcatcggccgctccgccgtgtgcaggataatgaagaacgaaaagcagagaatcaaaatgatcgagataacgatccaggaaattttaacgtatgattgttttttaactcttcgatgccgttgcatggtaacttcctctcaaatttcgttatttctaattatagcaaatatcggactgctcaaccgcagattaatttctgctttcaaaaaacttaaccatgtctaatacacattcatcaattgaacccttcacaacaggaatatcgttgcgtaaattggctagaatggtgctgccataccgcttggataataacctgggatccaaaataaaaatggttccgaagtcatctttggttctcaacaggcgtcccatgccctgacgcagcctgagagtcgctttggggagcgtaatactataaaatgggttcttacccttactgcgctcaatcgagtacagggcgtgattataagggtctgatggcgtatcaaatggcagctgggcaacaatcaggttttccagtagatttcttgggaaatcgactccctgccagaaagtattggcccctaacagaatagcgggttcatgatggatgaactgcttgctgattttggcagctgttccatgaacgccttgggccaaaacaaaatgggtcgctgtgaagccactttcctgaagcagccgatacgtccgttcaatcgcattgagtgagttaaacagtaccaaggtctgccgcggttcattcttataaataacttcgatattgtcggcaaccttttgaagataattatcggaattggttgcgaattgccggtcgtcttgatcggtaaccaaatagagtcgggcttgatcttttggattgaagtcgcttttgagtcgtttaatcgaagaatcatcgcgactaatccccaataagttgtaaatgaactgtgaacgtcgtgaagagaaaattgtcgccccggtaaaagttgccggttcaaaggcagaatagacatggtcgcggagataatcttctgttttcaaaatcccccggttaagtgtcaggctattgacgtctttgacattattgacggtgacccacgtcacatgctgctcaattgactggtcgtcaacatcaacgattgctaagagcaagcgtagttgatgattgaactcattgtagttttcaaaaaaagaataaatgcttaagaaatcgtggttggtatatgcgccggcattatggtcaatttgggcatttaaagtggccagcagtccgtccaagctttcgtggagcgcgcggagacggttgatcggctcttgattggcagcggtggctgccttcatctcattaattggaattaagcgctcgaagaactcggcgttgcggtggagtcgtttgcccttgacgaccatttcaaagagggtcgtcgtaacggtcgagaccaaggccttagcttgtcggagtttgccgtcaagggcttcgatcgcgtggtccaagatggcgtcgtcttccacaatttctttgatattatctccgtgagttccattaatatctgccaagattttgttaattgcggttgtcagtgataacggattaatccgctcctgattgttacgaatggcggtttcggcaaactgttgggtttcatcaatcagtaagtagggtttggtcggcagatccttgaaatactgccaatttttaattaaatagctatgattgacaatcaagaagtcagcattttgtgcttttttcaagttgtaacgcaaaaagtcgtcgtcataaaacggttcgtttggatccagccatttcacgccggtatgctgaattttccagacaaatggtgtttggtcgacgtttaagtggagttcgtccaaatcacccgtagtggtaaccgtcagccagaccaagatctgcgctttaataaacgcggtttgggtcgagttatcaggaacgtttaataaattgcggaacttgtagaggtcaatgtagtgactggcccccttcaaaatgacactattgactttgaaaggcagcccctcgttgagcattggcaacgtctgattttgcagctgaaactgcagataagttgtcgaagtactgatgactgccggtttgtgggcggacaccaaataactcaatggcagacaataccccaaactcttgccaatcccggttggggcctcaattaagagggtcttggctgcgtgatgctgttgatcggcataattgttatagatcaagttcatcattttattctgctcaagtcgcgactccaagttgtctggaagcagtttttgcttggccttttttgtttttggatagtgaagacgctgtttatcagactcatcagtcacgacgattgggtcctgttttcgtaaaaccagtcctgatgagattctcaggtgatcaggcaatttggcagcgtgcacctgccttttgttggtttcatcggcatccaaaaaaacctgcatcgtgtcttgaggcagagacggattaacactgatgatctgttccaaggtcattttcggcagcatcttaatttgtagtagtaaaataagcaggagcttggcggttgccaaagcatcactatcggctgtatggggatggtcatgttcgatattgaaataactgctgagatcctgcagccgataactggataacgttggcagcaggatttgacttaaagtgactgtgtcaattgcttcaatttgtaattcggggtagccgacgcgttgaaattccgagttcagaaacggaaaatcaaaattcacattgtgggccacaaaaaccgtattattgagtaaggaatacagctgagcggcaacctggtcaaaagttttggccttttgcagccgttcgttggtgattccggttaactgcacaattcggttagggacttctcgttgtggattgatatcggtcacgaaggtttttataattttattgttggaaaccaagcagcagctgaactgaattgtccgattatcggcagaaatgtctgttccggtcgtttcaatatcaaccacggcaaaggtggtttttgaattcattgtcattcaccaatctgtttatgagctgacttttcttaaatattcactaactttaatcatactacaagcaagatgtgataatctaccatggaaagaagtagaattatttatgaatctctaaaaatatcgttaaaacgttctcgaatcagcgaactatgataaaattggaatgtttgaaagtgagcggataaagttgaaagataaagcaactggaaaaagttacgcaaaaattatttggtttggtgagcatagtgtcgtttacgaaaagcccgccatcgccatcccaatctactccgttgatgtggttgcgaccattcaaagaattccagccggccaacaaattcactgtcgttactttgacggcccaattagtgaaatggcggagaatctgcggggtgttaaaacattaatcactcatctcgttagtttatttggcgctcaaaggcttgcttttgatctcgacatccaaagcaaactgcctgccgaacgcggaatgggatcctcagcggcaacggcaatcgcaattgtgcgggctttttttgatttttttgaggtcaatttgaccagaagccaattgctgaagttagcgggtattgaagaaaagattacccacggcaatcccagcggcctggactctgcgaccgccagctccaacatgccgatttggtttatccgaaacgaaatcaacgagcagattgactttaatttgccaacctcatcattggtcattgccgatagtgggattaaaggaaaaaccagtgaggccgtttcgttggttcatgataacctggtcgacgaaccggaaagttctcaaccattaattgacgagcttggcaagattgccgaaacggctcgcaatgctttggcaaccaccgacgatgtgctactgggcaaactaatgacacaatcccaacgtgacctggcccaactcggcgtcagcaaccacactctggacacattctgtcaagttgcttgtgacaatcacgctttaggtgccaaactaaccggcagtggtttgggcggctgtgtcatcgctctagccaagaaccaacgtgatgctcaacagatttcgactgcccttcgaaaagccggtgccactcagacttggattcaatcatttaagaattatcaattttcaacaggagaagctcatgacaacctcgtcagataagaccgttacagcagttgctcacacgaatattgccttaattaaatattggggcaaacaaaatcctgaactcatcatcccctacactggcagtctctctttgacgctggatcaattttatactcaaaccagcgtgacatttaacgccaacctggataaagaccagattacaattgatggccagccggtaaccggaaaaagcggtcaacgggttcacaacttcttaagcattgtccgccgagaatcgggaattgatttaaacgcccaagtcaaatcgactaatcatgtgccaacggcagctggcttggcatcctctgcctcggcgtttgctgcattggccgccgctgccagcaaagccgccggcatgaatctgagtttaacggacttgtcccgattggcccgccggggatccggttcagcctgccggtcaatctttggcggctttgtggaatggcaaaaagggtcagacgataccaattcgtacgccattccagttgagacgactcatttgaacgacatctgcatcgttgcattaaccattgaaaagcatcaaaaacccatttccagtcgggaaggcatggccctttcagtcaccacctccccttactatccaacgtgggttaaggtcgtcgaagccgatctggagaatatcaaagccgccatccaagatgatgacttcacgcgttttggcacaattagtgagttaaatgccatgcggatgcacgccctaacactgagtgccgatccggattttctctacttcaacggcgacaccttgaccgccatgaacgaagttaaacggctcaggcattccgggattgaatgttactatacaatcgatgccggccccaatattaaagtcatttgtcaacaagccaatgttcaaaccatcaccgataccttctcaaacctgtttggcccaaccaaagtgaccgttgccaagcctggcccgggtgtcaaatatttataaactagaaaggaaatgatccgttgattaaggttaaagctccgggaaaattatatatcgccggtgaatacgcggtagtcgaaactggctacccttctattattgtggctttggaccaattcgtaactgtcgaaatttctcgaagcaagtcctatggcagtatcgtttcaaaacaataccgagaagattcggtctattggcgtcgtcgcggtgatcaaatgattctggataaccgtgacaatacttttaactacataatttcagccattcagctcaccgaggaatatgcccagtccctcggccggcagatggagctctatgatctgcggatcaatagtgatttggatagccccaacggaaaaaagtatggattgggttcttcagctgccgtgacggtggcgaccgtcaaagctctctgtcagttctataacttaccgctgactaagagtaaactcttcaaactatcggcaattgcccatttggacgtccaaggaaacggttctttgggagatatcgctgccagtgtatacggcggctggatcgcttaccgttcatttgaccgcagctggctcatggctgctcgaatgcaggaagacctgatttccttagtcaacaagccttggccgcatttaaaaattacgcaattaacgccacctgacgggttgaagctgattatcggctggaccggttctccggcctcaacttcgcatttggttgacaaggttgcagttcaaaagagcaatcaacatgagacttacatccattttctggccgaaagcaaagcctgcctggacgaattgattgacggtttcaaaaatggcagcctgtcggtcatcaaagagggcatcgcccgtaaccgggaaatccttcaacatttggccgcttttaccaaagtgccgattgaaaccccaattctcaagaagatgtgcgacattgccgtcgaccatgctgcagctgccaaatcttccggagctggtggcggtgactgcgggatcgtggttgccgacaaagataccgatgttgattcaatgatcgcccattggcaggaaaatggcatccagcagctggcccttaaagtccatcccgtcatcgatcttgacaaggagtagcttatgacttcacaacattcccatcgtaaagatgaacatgtgtccctggctgaaaagttctaccaacctgtcgacaactcgtttgccggcgttcgctttgtgaatgccagtctgcccaaatatcgattagatgatattgatttaaccactcagcttggctccctgtcgctgacgacccctttttatattgaagcgatgtctggtggcagcccccgcaccaaagagatcaaccggcgacttgctgtggtggcaaaagcctgtggattggcgatggcggtcggctctcaaagcgttgggttaagtgatcctgaggtgcgcgattccttcagtattgtccgtcaaaccaatccaaacggaattgtcttggcaaatatcggtgccaaccacagcgttgaagatgcccaaaaagccgtcgagatgatcgccgccgatgctttggagttgcacatcaacgtcgcccaagagctcgtcatgcctgaaggagatcggggatttcactttattgacaatattcaagcaattattgccaacgtcggtgtcccggtcattgtgaaagaagttggctttggcatgagccaagcaactatttcacaactggttgacctgggagtgaagtatgtcaacgtcggcgggcatggcgggaccaatttcgctgccatcgagaacttccgccgttcctcaaaagacatggcttatttgacggattggggactgagcaccgttgagtctctattcgaagcccgcgccttttctgatcggttgggcattattgctgccggcggtgtgaaatcaccgctggacgtggctaaatgcctcacactgggtgcctcagcagttggcgttgcgggttactggcttcatgagatcatccataaaagtgacaatgaaattattgacgatgtcagagaatggcagtacggactaaaaacaatcatgttaatgctgaactgccgaaccgttgctgacttacaacggcaaaggttgatccttgatccacaattattgagctatttaaagcaaagaaaattagcctattaaaaaagagttaaatcaaaaatcagaagccacaatcttctgatggtgatttaactcttttttacatcgcaaatctcagccccttggggaagaaattcttggccgtaccattcacaactttggcaaagccgactggctgttgctggcaaaccaggaggtaccacccctttttcagatctggtgagacttggaatgtatcgccatgcacgtacttttgccaatccgctaagtctatagtgattttttgactgacttgatcgggatgcagtgccaaggctaagccataactaggttcaaagcggttctttttgaaagtgccaatttccaacccaagtcggacaattttaatgccagacaagttcggcgtattttccggtactgagtaaagatgatctttgaaaaccaccaatttgtcaaagtgaacgttctttaaggttgctttggcaaactggttgaacaattgattctgatctttggagggcatttcaatatttcgactgatgccgtggaagcgacgcggtccttttgcgttttctgcgttggcaggctttttcaatttggcaataaaatggccttctccgttaaaatgatgtggaaagatacgcacacagttggttaaatcctgattgccatcagcccaatctggttgaccgtcatccattccggcaaattttttaatcggttgaatttcaaatccgtaagtgtcaaccagccaggcaatgatctgctcatcctcttcaggggcaaaggtacaggtggagtaaatcaattctccgccaggttttagattcttaaccgcctgggtcaaaattgtccgctgacgggccgcacattcaattgggtaatcgacagaccagtattggacggcgtccgggtcttttcgaaacatcccttctcccgaacacggagcatccaccaaaatccgatcgaagaattccggtaattgggctgctaaatggtccggatccgtgttggtgacaatcgtattggtcatgccaaatcgctcaacgttttcaaccaacgctttggcacgcttgctgtcaatctcgttagcgattagcaggccggtattttgcagatagctgccaagatgggtcgttttaccaccaggcgccgcacacaaatccaataccctttctcccaggttggggtgggcaacttcacccacatacatcgcactgggttcctgactgtaaaccgccccactttgatgatcgacggttttgccgctgacctgaccatgatagccaaattggcagtgttccgtgggctcactcaggtccaaatcaattggttgactggctttcaatggattaagccgaaaacccggggttgtcggttcgtcaaagctggcaatgaactgggcggcttctgatttgcccattaattgctgatacttattcacaaaatcagttggtaagttcattctaatctccctttttggtactaataattgacgtggtaggtgtttttggatattataagtggatatgttagtaaggagtgatcacaattacaaagaaattaatcgccctcgacttggacggcacaaccttaaataacgatagtctaatcagcgccaaaactgccgaaacaattcgggcagctgctgagcaaggatacatagtcagtatcgtaaccggccgtcccaatagactctctgaaaatttttatgacgatttaaagctaacgacgccaatgattaatttcaatggcaaccttggcattttaccacatcaacagtggaatcgtgaataccagtacacaattgataaagaaattgtgactgaattactcgcaaaaagcaaaccgctcggcctgtcgttgattgccgttgaaggccggaatatgtttctggccaaccagggattaagcagtggtttcggcttcttccccagcaccttggccaccaatcaggtactgagtcgcaaaagcctaaaagaaaaccctattagtatcacagttcaagtggaacccgaactcaagcaggggttgattgacttcgttgaacatcaatttggcgacgaggttgaagtctccccttggggcggccccaatccaattgtggaaatcgccacgaaaggtgtccataaatccaccggccttaaatttttggccgattactatggcatcctgcaaaaagacattattgcctttggtgatgaaggcaacgatttgaccatgatgcaatacgcaggcaccggtgtcgcgatgaaaaacgccattgataaaatcaagggccaggccgatgaggtcacgaaattcaccaatgacgaagatggtgttgcccattatctccaagatcgactggacattgcggttggtgcttaactgagaactaaaaaccaaccatcgagacgaacagcgatttaatcccataatttaatgcagaaacgcagtcattccaaatgttggagtgactgcgtttctttgttaatggtcaattgtcgtaagtttgagcaatcaaaagtggtcagtgaactcacaacgaaaaaatgataaatgattagtcttcgtcgggatgatactgaatcgttgcctggacggccttctgccaaccggtatacagttttgtgcgtgtctgctcgtccatttgcggttcaaaagcatcgcgtgatttaacggtcaggcgaatttcttcgatagaatcccaaaagccgactgccaagcctgctaggtaggctgcacccagcgcggtggtttctgaaattgaggcccgctgaattggcgttcccaaaatatcagcttggaattgcatgagataattgttattagctaccccaccgtcaactgccagcgacttcaaatcgattccggtttcagctgccatggtgtcaacaacatccctggtttgataagctaatgactcaagcgtagctcgaacaaactgatttttggtcgtgccacgagtcaggccaaagaccgcccctctggcatcctgatcccagtagggcgcacccaacccggtaaaggctgggacgacgtagacgccatcggtacttttagcatcaatcgccatttgttccgagtcaggggatgacttaaccatttccattccgtctcgaagccattgaatggcagaaccggcgacgaaaatacttccttccaaggcataattgactttgccgttgattccatatgcaatggtcgtcaacagtccccgcttggaaagtgtcggctcctcaccggtattcatgacgataaaggcaccggttccataagtgtttttgatcatcccgcgctgcagcgccatttggccaaacaaagctgcttgttggtcaccggcaattccagcaatcggaacctgaacacccgagaaggaataaccagctgtataaccataaatttctgacgatgagcggacttccggcagcatgctttcaggaatgtgcagcaggtccaaaatatctttgtcccaagtcaacgtgtgaatgttaaacagcatcgtccgactggcattggtataatcagtcgcatgaaccttgccgccggtcaacttccaaaggacccaggtatcaatggttccaaacaataaatcgccattttcggccttttggcgagcgccgtctacatgatccaaaatccattgaatcttagttgcggaaaagtaggaatcaatgatcaagccggttttttcatggatcatatcatcataaccatcgtgcttgagctgatcggctaacgcagcggtttgtttggactgccaaacaatggcatgataaatcggctcgccggtatttttatcccaaatgaccgtggtttcccgctggttggtcacaccaattccccgaaccttgtatggttggacatccgcattaatcaaggcttctgagatcactgattgaacggcattccaaatctcattggcatcgtgttcaacccaaccagattttggaaaatactggtggaactcccgttgtgctttaccaacgatatcaccatcattattaaacaatattgcccgggtacttgttgtcccctcatcaatggacattatgtattgctgatcattcatgtaaaggtctccattcctattattcgtgcgtttaaacgctttttctttgttaagtatacaataatatcgactggcaaaccaaccttgagataaactttatcaaagtaaaagaatttgatgattgatccccgaattaaacgcaaacaaaaagcccgcaacagttgcctggcggacttccaaattatttgcgactatttttcgtcactcttgagcacaccgccaacgctataacggttcttttccatttcacttaaaattacgtgaacatgttctgcaggggcaccggtatttttaacaacggctgcggtaacgtcttccaccaagcccttcaattgatcttgagaacggccggcaattaaatgaatatctacaattggcatattttgattcctccatttgtttcgaatggcaaaagtataccttaaattatttttgcctgcaatatcttgatggcactttggacgtgtcaggaccgtttatggatcaaagatgatacaataattggagtaacatttaactgcgaataggagattttaaaatgataccatacaaaaacttttccgcctgtaccagtatgattgttggcaagaaggccagcattgacgggtcaattatgattgcccgaaacgaagatagtaaatcctcgtggccaaagaattatgtcatccacgagcatcaagaatttagtgaagccccggttttctcatccaaagacaacggcttcaagttaaccctgcctaaagtgcgctttcaatattctgccacccctgaatggactgacaagttcggcctgtttgaagaaaatggttttaatgagtttggagttgccatgagtgccaccgagagcacctataccaatcagctggctttgggggccgatccgctcaacgaagatggcattggagaagaagcaatgattacggttgtcctcccctacgtcaaaaccgcgcgtgaaggaattgctcgattgggccaaattgtggaatacttcgggacatcggaatccaacggcattttgtttgccgataagaatgaagcttggtatatggaaaccggcggcggccacaactgggctgcccaacgcattccagacgacggttacgcggtgattgccaatcaaagcgccattcaagacgttgattttaacgaccctgacaacttcatgtggtcacccaagattcgccggtttgtctccgaaaatcacttgaacccggatccatccgggaaaaccttcaacttccgtaaaatctttggtaccgctgacttgtcggacacggtttataacacaccccgcgtatggtacggcttaaaaatgttctcaccggaactaaattttgaaccaaccagtcaggaaatgccgttcatcaatcatgccaaccgcaaactgagcttgtttgacgttgaagatttcttaagctctcattatcaaggcacaccgtttgaccccattggcgagggctctgagcacgacaagcacctctatcgaccaattagtctcgccaagacgcaagaggcccacatcctccaaattcggccaaatatgcccactcctgctgcagggattcaatggttggcaatgggcgtcgctgctcaaagttcttttgtgccattttatgccggcgcaaacaccacgccaaaatcctatcagaatgcttcaggcagctatgcccccaatcaagcctattggacttacaagcttgccggtgtcttagttgacccgcattacgtcaaattcgggcccaaattaaatgacaccaaagccaaactgcgagtgaatttccaacaagcagtcaaacaagctgatgcctcacttcaaggtttgtccaatgtcgaactcgccaattatctgaccaaagtcaactttgccaatgccaagatgggcctggatgcttacaaccaattgattagtgacatcatcaccaattcaacagacctctcaccaatcaattttacccaagatacgaacctataacgactcgcctccaacagtaagataatctgtcttaaaaattgaataacgaaatgaagccggccacaaattcaattttgtgagccggcttcatttcgttatgatgactgatttagtttagtaatgttcccgcgtaaatgagcctggaagatcctgactggctttaacaaccaattttgtcagcagatcctcggtcgctttcatgacgtgatcagcagtccgggcattggcttgaccaagggctcgaacgacgtgtgagccggaagcctctttttcggccatctgcttatcaacttgcgcaattcgctcgtgagcataacccatttctttaagctgatagtcttcaatgtcttgcatcaaggcctgataatgatcagcagcaatcaatgaaatcaggcggtttgcccaataggcgttgtggctgtccagcgtctcggtggtatcacggtagcagtccggtgtattgacgacgttggtaaagaatggcgtcaacgtgttgaacggattggaggcaaatgtcagccactgaattgctgaataagccgaaggaattcctggacgcaactgcaagattgacagctcttggttgcggttgatgccaattggtcgatatggaacggtcttataatcagctcccggcgcaaatggatcgtaaggcgtgtcctgataatgggagctcagaacgaatttgatatcttcaatcgtaatcttgcggttggcgtggcagataaacggcaaatcattgctcattggcgtcttatccttcactgattccggatcgaaatatcgttgaccataccaagcacgcggcgtgttgtagtgacggtccagctgggtatcagagccaaagaccttcctgaagttaaagtgactggttgggttgagatggtgctcctgggcaaatttacgcaagtcttttgagaacataaagctgtctggatcatcgaaatcgatctcttggatgcctgtctggttgggcgcgatgacataggcatcatctggaatccgttgggctacccagtgatggccgccggcagtttccatgtaccaaatttcgttgacatctgaaaacaggattccgttggactcgtatgtgccgtatttctcaagcagtttacccactcgttgaaccccttctcgggcagaattgatatatggcagggtaattgttaacagatcttcttcgccaaggccgtctttttcaaatgggtcggcaccgatcacccgagaattggttgtaatcgtctctgtggcactcattgccacattatgggcattgatgcccgcctcgccccaaacgcccttgtcagggacagcatcgggcactgaggtatatctcaatggattgtctggcagtttaacactaaacttggttaattttgactgataattgcgtggttggtcttctggttcaacaaccacaaacttctttggattaacggcatctccggcatcctcatttctggcgatgatggttgacccgtcatagctggccttcttgccgactagaatagttgtacaactactgtgttttgatgaaaacattttgaagcctccccttgtctttctatcaccttgattttacacccttttgtgcattgtggaacaaaagaccgttgaatgcaaaaatggggattgcggcgaggcccgctttctgtcaaagggatcaatttaacagaaatgattccgacggccaagggacactgcctgagtgaggagcaccaacaatgaacaaaattcgtgccccgaaatttattcaagattgcttttacagggatacagcagttagtttacttcgtgcttccttcggcctttgagttcagctcctacgccccaggaccctactacataagtgaggagcaccaacaatgaacaaaattcgttcattattggtgctcctcacttatgctccgggtcctaaacagggctcgtcgcatgcttatttttgtgccggttcctcatagtcgccgtttggacaaactacttgtgtgccgcccttgacccgtttttcaactaagaagtgaccatcctttggacaatctctgccgattggcttgtcccaagaaacgaaatcacaatccgggtatcttgagcaaccatagaagatccggttctttcttgattttcgctcaatgacctgccctttatgacacttgggacaaatcacaccgatttccttaacaattgctttggtattgcgacaatccgggaatcttgaacaggcatagaatttaccgtaacggcccattttgatgaccattggagcgccacagatttcacagttaatacctgcgggttcatctttaatttggaccttttccatatttttggttgcagcatcaacctcgtcggaaaatggtttatagaacgtatcgactaatttgatccagttctctttaccttcttcaacctgatccagtttgccttctaaatttgcagtgaagtcaatgtttaccacgtctgggaagtattcaacaataatcttgttgacaatttcccccaattcagtcggctcaaatcgacggccaacttccttaacgtaataccggcgctgaatcgtatcaatggttggtgagtacgttgatggccggccaacacccttttcttcaagggctttaatcagcgttgcttcactgtatcgtgccggtggctgagtaaaatgctggtccggattattcttgaccaacttaacaacatcgctactctccaaatcgggtaacaagttgtccttttctttactatcaccataaaccttcaagaatccatcaaacttcatcttggacccattggctttaaaggtcacgttattttgttcaattgtcactgccatggtatccatgattgccggagtcatttggctggccacaaatcttgaccaaaccatttgatagagtctaaattggtcgcgggtcagatattgtttcaaactggccggcgttctgaaaacggaagtcggacgaatggcctcatgggcatcttgggcaccctcgggcaatttgcctttaattggtttggttgccgcatattcggcgccgtatttctcatgtagaaattgggacgcttcgtgtttggcaatgactgaaattcgggttgaatcggtccgcatataggtaatcagaccttgactaccctctttaccaatattaattccttcatagagctgttgggcagccatcatcgtctttcgtgttctgaagttgagctttcggttggcttcctgctgcattgtactggtggtaaatggcggctgcggttggcgcttccgttcacgacgggttaccttggtaatatcaaagtcacctttgggatccaactgctgcagaaccttttgaaccgcctcgttatttggcagttcctttttcttaccgtttaagccgtaaaaggcagctttgaacttactgcggcccttcttaaattcagaatcaattgaccagtactcttctggggtaaagtctttgatggccttttcgcgttgaataatcagccaaagggcgatcgattgaacccgcccggcactgagcccctttttaaccttttgccagagaagcggtgaaattgaatatcccaccaaccggtctaaaatccgtcgggcctgttgagcatcaacgagattcatatcgatatttcggggatgcttgaatgattctttgacggcatccttggtgatttcattaaataccactcggttatcttcgttaggatctaaatccaaaatgtgctgaagatgccaggcaatcgattccccttcacgatccggatcggctgccagatacacttttttggcctttttagcggctgaccgtaattctttaattgtgtcacccttaccccgaatggaaatgtagtgcggttcataatcatggtcgatatcaacgcccatcttactcttgggcaaatcccgcacgtgtcctttactggcgaccaccttatatgaacggccaagatatttttctatggtcttggctttggcaggtgactccacaatgactagattttttttaggcgattttcgcttagtttttgattttgctttggcttttggtttcgtttttgtagaagttgccatattttctcccctcaaaactgcttatttttagttatattattgtaggaatttttattacaaatctaccacatcatattgcaggaattttaaagtgtcaactcactacccttaaatccgcgtctgaaagtagtcctccaagatgtccaactcacgtaaaaccggttttgcgccagcagcgattaattcattggtaccaacggaaagcggcatcataattgaccccgggacggctaagacattgcgattattttgcagggctaaattggccgtgatcaaactaccggaatgttttttggcttcagtgaccagaacactttgaaccaatccggcaatgatgcggttacgttccggaaagtgatttcgatagcccttggtatgattgggatattcactgattaacagatggtcggcggcaatcgttgcttgtagttcctgattggtatatggataacacacgtccaaccctgtcccaatcacggcaatggttttaccttggttggcgatgacacattggtgggccaacgtatcaacccctttagccagccccgacacaatagccattgtattggaaactcttccaggaatcaaattttttaggatttcaactgaatatgaggtgcagtcccgcgccccaacgattcctaaaagtggctgggataaaagcgacaaatctccgcgataaaacagcactaacggcggcgcaaacgattctcgcaattgaagtggatattcagcatctgcaatgctcagccactgttcaccatcgaccagctggtccactttgtcgtcgtttcgcattaactgttgatagctgattttgaagttagcggtgttcttaacgtttagttgagcgacggcagccaagaatcctgaggtcggcagttgatcatcccgccagtcgacctgatttacccaagtataaatttttgacttaccaatcatgccgattcccttacataaatgtattcttaacaaaaaatctcttaaaagcattgtcatcatccttttaagagttatctacgtaaaacatatttatttttggctaaactttttcaccggggcaaaactcattcgatgaatcggcgttggtcccagttccttgagagctgctaaatgcttggccgttccatagccggcgttgtgtggaaaatcgtattccgggtactgcttggcgtactcgtccatcaaatggtcccgatagactttggcgacaatgctggctgcagaaacactgatgctcttggcatcacctttgatcagtctggtttgccgaatcggaacgggaatctgcatggcatcaacaatgatttcatccggctgtggggttaaagattccacagcttgtttcatggcaacacgagtggcttggtaaatgcttaactcatcgatcccatgattatccaccgatccaatccccacgctcagggcttcagctgaaatgagcggggccaactctgcgcgttgggtcggtgtcagctgcttggaatcattgacggaaaccaggtcaaagtcgtgcggcagaatcactgcagcagccaccactggccccgccagaggacctctgccgacttcatccacaccggcaacatattgcagcccctgatgccaaaaagaccgttcatatttaaaccgctgttcaaattcatccagggctctggcctgcttttgcaggcggttttctgttgactgaattgccaattgaaccccttttcgcgggtcagcctttaactcaatcaaccgcggatcggtgagatcagacatctgggataaaagctgtttaacgtctttaattgttagcttggtcatcgtcactcaccgtttcaggatcatccaaagtaaaacgaccaattttgccggcacggaaatcttgaataatccgattggagccacgttcataatcatcgcgcatgccgactttcttagtaatttgtaacagcaggtcaacgtcggacaaatccaaatcgtcgtcagttaagtgataacggtctttgaggccttccgggtgaagctgtctgatctgctttaagccaaacaaggcaatgtcgtcactggcataaacgctctctttaattgcaccggtcaatgccagcttgtcggcaacttcttgactggaaaattttggccacagaattcccggtgtatccagtaattccaacttatcagtcgatttaagccactgttgccccttggtcacaccgggacggttgccaacctgagcggctcgacggttgaccaatcggttcaaaacagttgatttcccgacattcggtaccccaacactaatggctcggatcggtcgtttcttcatgcctttatcctgttcccgctgcaatttgtcacgcaaaatgggtgaaatcaccgaaatcacattattgatgccaaatttggttttggcatcaatggcgattgccggttggttgtgttcagcaaaatactgcagccaggcattggttaattgaggatcagccaaatcacgctttgtcatgatataaagatgcggcttatcggcactgattcgtcgaatttcagggttttgagaagtcagcggaattctagcgtcaatcacttcaaataccacgtcaactaaagaaagattttcttcaaactgacgaattgccttggccatgtgtcctggaaaccattgaattgttactgccattgtttcacttcctaaaagctttcttgatattccttccacacggaatcaaaaatttccatggtcggaaggtatgaagcattttcttctaaatacttggataacgcgtcaaactcatcttcttgtttgggaaatgactgatcataaaatgcgttgttggcaaattcagcctctggatcagtacttccggggttgcgtttggtcattaaatattggtagaacgttttgtgcatattagtcctccttgtcagtggtcggcaaaagaatctcaaaggcaaattttccttggcctttcaaatcgatggtccgggcccgataattaatcccattcttaccgttcatgtgaattatatcaagtttgattgttttatctttaggaatcagttggacccactttggcagtttatagttttgtttgacatacattaaaacaaaactgattgggaccgggaacttccccagtgccagcttattagcgtgaagttcaatattaccattgggcatcactttcgggtcgaaggtcagtgaataatcgacgttggaacctaataaagtcagtgagccatagacaatcccttcgttggcgacttcaaagtgatattgcgaaggtcggcccttctgcagcttatctaaataataattggatagttgattgagttgagctttattgatagtggcggaaattggctccgactggttggtcgacttttgatttaccaatttcgttgtagatgacgataaagaaaccgccaaaaacatgccggcaactaaaacaaccaggaggccgattaacgatatgaaggcgattttccaaggattgcgggatttcgtctgcttggaggcttttctcattttggatcactcctttaaccaggatatgtgcttggccatttgggaatacaagcgattggtcataatttgataccccttcaaattcgggtggaaatggtcatcatttgagagatatttatttgactgggcaggttggccactcaataactgctcaatgtcggcaggcgaatcatgattttcggcgataatgctggcagcggccttttcttccaaagcttttctggatttggcagtggtaaactgaccgtctgtaagcggtttgttaatcgagacaaagtacatcctgtgctgttggtggatcactttattggtaatctggttggtatgagccacggtgtcgttgatgtagttgacctgggggaagtaaacgtagacaggattgtaaatgccaaaaacaaaaatcggcgcccgacggtttaagtggcggatatttcggaatagccgggtaaccctagcttgatatgtttgacaataactggtcaatttctggttcaactgatgtttgttcaagccaacaacgttcgccttcaaaaacttcagtaaatcgtttccaccagtggtaatcgtgatcacatcggcttctcgtatgctgtgctgcagccgttttgaataaaccacccgatgattaatttggttagtagtttcccctgaaatgccatagttggcagtggacaggtgaacattgggatttttttgaatcactttttggcgaatcaagtgggtatagccgcctttgttggtcggatcgccaaccccttgagtcagtgaatccccaacagccgttaatttaacttctcttggcagtgtttctttggccgagttgaaataatggtagccgaaaaatgcggctgccccaatcacgatcaggccgatcaatccgataatccaacgaaaatgatgctgtgtctgtttaacatgtttattttgactcacaaaaacaacctctcaaatggtgatcaaatctaaaaggggtgacaacaaaacagccgctttgcctcgcccctttaagcaatatttcagatctgcaattactcgggatcactgtaataaatcaacgcgaaagcccctttaccggtatgcgtggaaatggtcggtgacgtcacccgttcaagaaatgatgcatcgggaaagtcagccttaagcttttgaacagtgtcctttaatacttcagtttcagtgacgtatgaaacgccaatcgacttaacagcggcggtgtttttcatttcatcaataataccattgaaaaactttttaagcgatttatcgccgcgacctttagaaataattttaagtttgccgtcagtgacttgaagccccaacttaatgtttaaaaagttggtgattgccccggcaatcggatgcaatcgaccgcccttgacaatattatccagagtcatgacacataaataaagcttggtgttattacgaacctgattgactctggctaaaatggtatccatgtcggcaccttgctgggccagcttagccgcttcgagcacttgaaagcccaagccgcggtcggtactttgactgtcaaccacggtcacatcggatttgctgattgtggctgcttgttcggctgcgtgaacagtgccgctgatggcggccaacatattcaaacagagaatttggctgccgtcttcacccaaccggtcaaatgcttcaacaaatttaccaactggtggttgactggtctttggcagatcgtgagccgccaacatttgaggaacaaaggtttcattggtgatcgtatcacgatcaacgtagaccgtatcatcaatcatcactgttaatggaacaattgtaatgccgtattgtttgagttcttcatctgtcaactgggcagatgagtccgtcacaatttttacttttgccatttacgccactcgtttctttacaaaattaataattaattgatagtccaacgacaattatatcaaagttctgccaaagattcataagcatttatgccggcgttattttctatcgaaaacttcaaaagtgtggggatacttatttttggcgtcaacaacaccaacgaccgatttgctcaattcaaataaagaatagtcaatggctggcatataggtgtcaccggaaaattcagcttcaatcttcgtgcgataaagccggtcgacttttgaacgtaattgggcaaatagattggcaccaccggtcacaatatattgtttatcgggattttgagcaatcaagtcacacagttgttcaatcgaagggataactttgatgcccgttggaaaatcagtttggtgtgaaaccacaatattctcacgacccggcagtggccgattataactgcggaaggttttcgatccggaaataatcgtattgcccatcgtggtttctttgaagtaatgcatatcgtccggcagatgccaaggaagttgaccattggcaccaattaaaccgttggcgtcttcagcccagataaaagctaacatcgacttcctcctaaaccgcaaccggcgctttaatgactgggtatgggtcgtaatttttgaccttgatatcagccatttcgaattcgtccaaatgtttcttttcaggattcagccacaattcgggtgcctgacgaggtttacgggaaaggagttcctcgacttggtcaatgtggttaaggtaaatgtgggcatccccaaaggtgtgcacaaaatcaccaacttccaagccacactctctggcgatcatggaggtcaataaggcgtaactggcgatattataaggcacgccgaggaaaatatctcctgaacgttgatacaattggcagcttaacttgccatcgttgacatagaattggaataaggtgtggcaaggcggcaaggccattgttggcacatcctctggattccatgccgaaacgatcatccgtcttgaatcagggtgagttttaattaaatcaatcacattttggatttggtcgatcgttccaccagtggaagtcttccaggcccgccattggctaccgtaaaccagacctaagtcgccatactttttggcaaaatcatcgtcgttgacaattcgatcacagaataactttttttgctcctgataaactttgttgaattcgggatctttttgtgcccgatgagaaaagtcagtcatatccgggccggtatagtcatttgaagcgacaaacttttcaaaagcccactcgtcccaaatgtgattcttatgcttcaataaaaattggatgttggtgtcacccttcaagaaccataagagttcacttttgattaatccaaatggcactttcttagtggttaataaaggaaatcccttggataaatcaaatcgcatctgatagccaaacgtactgatggttccggtatgggttcgatcagtttttttgtggccattttccaaaacataacgtgcaagatctaaataggcgtcttctaacatggcaattctcctttttatcagaacgtgactgtttttaattattcagcgtattcgcttaaatattcccagcgtttcatctttttatcggcttcggcagacaactggtccttttgtgcttgaagatccgccagcttatcataatccgagccattgttttgcatctgcttatcaatgtcttcaacttgagattcgagcttttcaatttcatcttcgatgtgatcatattcaatcttttcagaatatgtcagttttttcttggctttggcatttgaagcggttgcgtcttgacttgagattgccgaatccgattgagaagttgactgcccgctgtctgacttggcagacgatttcgacgtctttttcaatgaggccaggtaatcggtgaaccgaccgcggtgttcttcaatcacaccgttgcctttaaaaatcagcaatcgatcagcaactttgtccaagaagtaacggtcatgggaaacggtaatgacggtcccttggaatttggaaatgtaatcttccaaaacggtcaaagtcgcaatatccaagtcgttggtcggctcatccaagagtaaaacatttggttgctgcatcaataatttcaacagatacaggcgtcgtttttcaccaccggaaagtttacggattaacgtgccgtgcatgaaacggggaaacagaaattcttcaagcaattcggcaacactaatcttgttgccggtattatcggtgacctgttggccaatctcactcaaataactaatgacccgcttatcttcaggaatcggctcggtcagttgcgtatagtaggcgattttgacggtttcgccgactttgataattccagaatccaatttcagccgaccggcaatgacgttgagcaggctggtcttaccggcaccgttctcgccactgattccgatccgttcattcggctggacgagaatattgaaatccttgagaattgttttgccgtcaatggttaaattggcatctttcatcttaagaacttccttgcccaatcgggtctggccaagggaaatattgacatcctgatcaagctgtaaggtaccgacgttttcctttaagtcattaaaccgattaatgcgggcctgctgcttggttgaacgggccttcgcaccggtcttcatccacgccaattcctgtttgtagagctgctgagtcttatgctcggcttgaatttcaccttgaacccgggtcgctttttgctggacataatcttgatagttgccatcatactggtaaagtttgccaaatgacagttcccagattttgttagcaacatggtccagaaaataacggtcatgggtaaccacaatcagggatcccttataagccgccagataattttccagccagtcgatggaatcaaaatccaagtggttggtcggctcatccaacaacagtaagttgggcgcttgaatcagaacttgtgccaaccccactcgtcgtctttgaccaccggataattcggaaatcttctggttataatcggtaatcttcaactgggtcaaaatcgttttaacgtcactttgcgcgttccaggcgtcttcttcattcattcgggcttcagccttggtatatcgtttggctgcttctgggtcctctggatgcgttgaataatctttcaaagcagcttcgtaatggcgaattgttcgatagaccgtttgcgatccggaaaaaacggcatccataattgacagactctcgtccagttctggatcctgctttaaataaccgatggtgtaagatttcgaggtaataatgtcacctgtcgagtcatggtcaatgccggcaatggcattcaataacgatgtctttccagtcccattagtcccaattaagccaattcggtcgtgttcattaataataaaattcagcttatcaaaaagcgtcttctcaccgtatgtttttgctaagttctcaacgcgcattgtttccattcaattatcagtcctcatttaaaaagtcgatagctgcctgaacaagatcttcaggttcattgttgatcttatcggcaaccacattttgttcaagataattcaaaacctggccaagctgtggactgggttttaaaacccctcttttaattaattcaccaccggttatcttcaactggtgcttatttttaatggcaagtcggttataacgttcagatagtccagtagttttcgactggtccgcaaacactgcgattgcgttgtcgacgttttcacttccggcatgataaagggttaaattagtcacttgaccacgttgaattgcgaaaagtaattcaaccgtaagtataacatcattaattattttattggcagtcttccatctttttaaaaagcgggtaatttgttggctgttgaatccgaatttaaaagccagaagggcccaaacctgaacttcattggtcagggtgaaatcagtgtcggcgatttgtctgagttgaactaaatgttcacctagtatcgggacgtgttgatataaattcgtctgaatcatgatcttgaggccgtggttggcgtctgatcccagcatcattttgacaaactcggtgtgggagcgttccacggcaatttttgccaataactggctatggcgggcaatgccagccagtgtggcatcctcaatcttgaagtccaattggctggcaaaccgaaccgcccgcatcatgcgcaaggcatcttcattgaatcgctcattgggatcgccgaccgcgcgaattatgtgttttcgcatgtcgctaaggcccccaaacaaatcagtgacctgtccgttctcagccaatgccaaagcgttaatcgtgaaatcccgccgtttgagatcctctttcagtgagcgcacaaacgtcacgtgatccggtctccggtaatcttggtagccggactcagtccgaaaagtggtgacttcatacccagtcccgtgatcaagaatcatgacggtgccgtgctcaattcctgtgtcaaccgttcgtttaaacaacgccttaacctcactgggataagcgctggtcgcaatgtcgacatcgtgaatcggccgctttaaaatcgtatctcgaaccgaaccgccgacaaaataggcttcatagcccgctgattcaatcttttgtaaaattggtaatgcttcgtggaattcttttggaatttctaccatccgcacaataatcgccatccatttaatatttatcctgttgtaattttaacagaatttccgcttgaaacaaaaagttcggtgaaatgattgccaattgtcaattagaattgctatgatgagttgtcagatcattcagggaggaaaaacgatggcacaaaagcaaagtcgcttcaaattagatatttcgttaattgatttactggtaatcgcggctggaaccgccatttattcatttggaatcgtcttcttcaacatttacaatcatttagccgatggtggcgtgaccggtatcacactgattctccgggccctgtttcacattgacccggcctattcgaccatcttggtcaacgtgcccctgttcgcgatcggttatcgctacttaggaaagaaagatatgttttataccttatacggaacaattgccctggcaatctttttatggatttggcagcgggtcccaatcgtgattaatatcgatcatgacctgttgttgtcggcaattggtgccggcttatttggtggctttggctgtggaattgtttaccgttttggcgggacaaccggtggtgttgatattgtcgcccgcttgttcgagcggtttaaaggtgttcaaatgggccaaacgctgctcacaattgatgtcttggttttgctgtcatcactcatttatttaaacgtccgccagatggcatatacgttgatttacgtctggattttttcaatgatcgtcaacttcacccaacgcggcgcttacacggctcgagggatcttaatcattagtaacgaatcagaaaaaatatccaatgccatccaagacgagctcaatcgcggcgtcacttttttgaatgccgaaggaggttattcccaccgctccaaacagatcatctattgtgtggtctccccaagcgaactgcacactttaaaaaagctggtcgaatcaatcgatgaagaggcctttatttcaattattgaagttaacgaggcgatcggtgaaggcttcacttataaacggccaaagcgattcaaactgctatagaactagagaactgcaatagtttatatgtatgataaaaggtcacccatttgggctatcccactaaggtttactttaactttggcgagatccctaactggtgacctttttctgatgtttaattgcagatcgtgaatcacatttcatcccacaattctgccatttccatgtcatcggggaccaaatccaagtattttttcaaggactgtttttcgagatccggtttgccgatttcgcggtaaaacagcgtggcgtgtttaagaaaatcgggattatcggaaagttcattggcggccaattcgtaattgttggcggcttttttgatttcaccggtattttgataagacagtgccaaattatatgcaagatgggcatcgacgacgtggtcttcaaaaaccccttctaaaagcttcagattatcgctgtagcgttcgtgggcaacgtaccagtctgatagtaaggtcaggatttccatgtcgtcaggggcgatctcatggcccttttggaaataggtcaaggctaaatcgtcttcgttcgccatttccgcaatttggccggccttctgccagattttttcgttaaattggtcaatggaaattccttcttggatcgcctttaatgcttcatcaacccgtttgaggttaacataggcatcggccaagtatggatacagtgaactgtactggggatctgaatcacgcaaatcctcgaaggctttaattgccttttgatactctttcaaattaaagtaggtgaatgccagttcaaatttaacatcggcgttcatattaatcggcttgatctgttccagataacccatcgcttgttcaaacttaccaatttcggcataggaaacacccagacgttcaaccaggttgactgaagacatttccaacgtaccagaggtgattagtgctaaatataaattaatcgctttgcggtagtttctagtcgtgaaataaaattctgccagagcaaacttgatcacatcctcatcaggagccaatttttgggcttctaagagcttttgttcactaatctcgaacattccctgggtttggtacagatcggccgcaaccatcaaggaacggacgtattcgtccgactgcggcgaaacctgtgacagataattgagagctttgtcgtcttgatcatcatcaatggcaagttcggcgagattgatttttagaccgtcatcgttgggatattttttaaataatttttcgtaaatagtatttgagtaatttgaaaagccgagtgaatacagctcttcggccaatgagtacagcaaatcatccgaatcgtgatccaaagcttgctgaaatgatttcttaaaatcatcaatttggccgccttcaagttggtctaaagcagtttttgaatagctcatatttgtcctccaaagtgtataaaaaaagccagcccgacaaatgccgttctggcttaacagatgaatactatttaacagcatccttgagcgccttaccaggtttgaaagctggtaccttgcttgcaggaatttgaatttcttgacctgtttgtgggttacggcccttacgagcggcacgttgacgtacttcaaagttaccgaaaccgattaattgaaccttgtcaccttttgctaaactagcttggattgattcaaatactgcatccacagctgatgtagcgtctttcttagtcaaaccagttgctgctgcaacattggttactaattctgctttatttgccatgagtgtattcacctccctcaaagataggtatgtaaaccattgcaagtcgaattctcacaaatccggaatgctgaaataacgccgtttgccaacatcatttctttttcaaagatagcataagaatgccgtcattgcaatggttttgcccaatttagtgtcgataaacgccgaaaaatcaagattttgttaagaattgctgatttttgggctattttcggctgcgtttgatgattctgattggtgttccggtgaagtcaaaattatcacgaatttggttttcaaggaaccggacataagaaaaatgcatcaagtccggattattcacaaacaccacaaatgttggtggcccggtcacgacttgggtcgcataataaattcgcagtcgtttgccattaaccgttggggttggatgaacagcgaccgcccccataatgacatcgttgagtgctgaggattgaacacgcttctcatgattgtcataaacctgtttgattaatgccggtagtttttcgattctttgcttagtaacggctgaaacgaaaatgatgggcgaatatgacatgtactggaattcatttctgatcagggtttcaaagtcctgttgcgtgtggttggtctttttgagcgtatcccacttattcaccaccgtgatgattgcttttccagcttcatgagcgtatccggcaactttcttatcctgctcacgaatgccttcttcggcgttcatgacgaataagatcacatcactttggtcaatggctttcatcgcccgcatgacactatatcgttcagtgttttcgtaaaccttcccgcgttttctgattccagccgtatcgaccatcgtgaacttgataccatccgcctcaaagcgggtatcgattgcgtctcgagtggttccggcaatatctgaaacaatgacccggtcttcacccaaaatggcgttaaccagtgacgacttgcccacattgggccggccaataatactgaaccgaatatcatcgttatccgtcttttcatcggtctttgggaatttttcaacaaccttgtcgagtagatctcccaatcccagaccatgcactccggaaatcggcattggatcgccaaatcccagtgaataaaactcatagatatcttcacggctctcaggattatcgaccttgttaaccgctaaaacaaccggtttgtcacttcgataaagaattttggcgacttgttcatcttctgcggtaaccccttccttaccgctgacgataaagacaatcacgtccgcttcgtcgatggcaatttcggcctgactcttaatctgggttgcaaatggtgcatcactgatttgaattccaccagtatcgatcattgcaaatttagttgccagccattcaccatgagaataaatacggtcccgggtaacacccggggtatcttcaacgattgaaattcgatcaccggcaatgcggttaaagatagtcgattttcccacgtttgggcggccaataaaagccactgttggcaatgccatgtaaatccctcctttgcttggttaattcagaaagaaaggagctgggacaaaacttgcgttttgtttccagccccttttcatgattaaaataattgattatttgttatcatcgtcatcattgttgccggacttcttcaattcgtctccaatgatatcgcccaaagtaaagccggtttcttcttccggtgcattactgatggaacggtcgttagacttccgtgagcgtgatggtcggttgtttgacttctttggcttggcttcttcttcaggagcatcggtcaaagctttgattgataatgccaaacgctttcggtcagtgtcaacatcaagaaccttaaccttaatcttctcgccaaccttcaaaacatcagcaggtgtatcaatgtgctcatgggcaatttgggaaatgtgaactaatccctcaacacctgggaacacttcaacaaaggcaccgaaatcaaccaggcgcttaactgttccttcaagaacactgccaactggagctttttcttcgattccgtcccaaggttctggaagagtttgtttgattgaaagtgagattcggttacggtcgaagtcaacggataataccttaactttaactgtttggccaacctttaatacatctgaaggcttgtcaacacgttcgtaagcaatttgagaaacatgaaccaatccgtccatgccgccgagatctacgaaagcaccgaagttggtaagacgagcaacggttccttcaacaacgtcaccttcgtgaagagtttgcattaacttttcacgttcttcagctttttcagcttgaacaattgccttgtgagacaagatcaggcgattttcaactggatcaatttcaataatcttcaattcaagttcttgacccttgaattggtttaaatcatcaacgtaatggtcagaaatcattgaagctggcacgaatccacggacaccggcatcaacaaccaagccgcctttaacagcttggctgactttggcagtaatcgtttcatcattctttgacttttcagccaattcatcccaaactttgcgggtttccaaacgctttgaagaaagcaggaaactgccgccttccttgtcgctgccgattcgagaagtaacaaccaacttgagcttgtcaccctgcttgatatcgtcaacattttggtcagacgaaagttcacgtgggggaacaacgccttcaacaccggagccttcaatacccacgattaattgttgactgtcatctttggccaatacttcaccggtgacaacatcgccaacctttacttcattaacgctgtttaaagcgtttaataaatcatttttatcattatttgcattttcactcatcaaacaattcctccttgaaacaactctaatcataattttatcttaaattgaacaatattaccagtcaattgactaattagttgttatttcagtgttttatttatcacatcggcaatctttgaaaccacctgatcgatagaaagtgacgttgtatcaatttctacagcgtcttttgctttggttagtggtgaaatctttctatgagaatctttataatctctggcttcaatttccaattgtagttcatccaaaggggtattaatgcctttttgaatgttttctttatatcggcgctgtgcccgttcggcaacactggcaatcaggaagattttaacttcggcgtcaggtaaaacggccgtcccgatatctcttccgtccatgacaatgccaccgtctttagcgatttcctgttgttgagcactgagctgctttcgaacttcgccaatggcagcgactgccgaaactgaattggtgacatcttcttgacgaattgcctcggtaatttctttgccgtcaatgaagaccttttgtccgtcatcactgggttcaaaagtaatttttgaggcatggacaattttgccgatctcgtcaacgtcgtcaaaggagacgccctgacgaattgcctgcagtgtaattgcccgatacatggcaccggtatcgcagtagatatagtgaaattgctttgctacccgcttggcgacagtacttttaccagcggaggccggcccatcaattgctacttgtaatccattttttcgcattctaacattccttacctgacattatttttgagtgattctttaaagctaccgcacccgaagccgttgccccggatacagcttggaattggcatttagcccgttcatccgcatcagctgttcagtggtcaaaccgttattataagcaacccgaaacatcccctggccggccttgacagtggcgtattgatggccgctggcagcagtcgtcttgttagtcgttgaactgctggttgccgactgggcgttactagattgcacactggaagcagacgatgtcgagctcgaggctttcggttgggttgaagcggctttactggccgactttggctgctctttctttacagctggcttggctttggctgaattcgatttggctttggccgctgaagaagattttttttttgcgttatcctgtcggacgaccctgacagacgaagacgcggcactctttgaatcattgcccatcgcactttggcgaaccaggccgtaaaccagcgcaaccaccgcaacgataatgattaacgccgctaagaccatcgtaatcagatggtgattttggctctgctttctaagtttgactcgcgaaagattaccattttcatcacgatcctcagaaaatgtttgattccagggctgatcttcgtcagtttttttatgttcatcattcgaattcatattgacccccctcttgatcaggatatagacaaacttattttatcattaattcacttaaatttaccttaattttttgataaaaacagctggtcaatgacttgctgccagcctttggtttcgttttggccggatttttccggttgaatcaaatattgccggttaaaatcctgccagcgattccaaaaatcgacatcgtgatcgcagcaaaatgccgggttccgctcgccatccgggactgtttcatcaaaatacttcagcaactcatcacgccgacatttttccgtgtagacgtattggaccatcgcccccagttccttcacccgccgagtacgagcatgatcaaagatcgatttggcctgctcaaacgagtcgccgctgtcatgataatacttgaccacccgaaactgatcatcggtggctaatgccttaggatgctgatacaaataacgcaataggctttcatccgggatcgtatggtcgatcagacccatttgtaggccgcggtcattgggttcatacatcaaaattgccaaccccggttgttgatctctcccgcagcgaccaatttcttgaacgtagctttgaatgttcgccggcaggtggtaatgaatgacaaagcggatgttatccttgtcaatgcccattccaaaggcactggtggcacagacaatgtccaaattccctgccaaaaactgctgttgaatgtgaaaccgcggctgactgtccatccccccatgataagccatcacccggcgattggtttcattcgtcaacgtgttggcagcctgctcggctttactcttactggaaaaataaatgattccaggtccattgagctgcttgaccagttcaatcagagcagcgtctttatcatgttgattggcaaaaattttcgcacttaaaaatatgttggctcgattgacaggcaagacaatttggtgaacgtcctcgaatcgaaaattcatatgccgaataatatctcgccgaaccggttgggtagcagtggctgtcatcattaacgtcagtggccgccccagcatctcccgcaccgtccctaatttgaggtaatccgggcgaaaatcgggcccccattcagaaatgcagtgggcttcatcgacgacaaacaggccgatgctcagccgcctcaaccgctgttgaacctggtcatttgccagcatttccggagaaacataaataaactggtaacgattcaaatgatttaaaatcgccattttctcttgaaaatctaacgcggaagtcaacgcaaccacccgtttggatcccagaaattgcagtcgactgacctgatcctgcatcagagaaatcagcggtgacacaatcatgacccgttgatgggtgattgccccatacatctgataaagtaaagttttgccgccgcctgtcggcagaatcgccaaggtatcctgatgggccaacagattctgtaagattttttcttggcccggccggaaggtgtcaaagccaaaatatttttttaattcacgtttgagatcaatgaccatctgtcgttttactcctgtatatctgaaaaagtcgaaattggaaaaatgccaattgattaaccacctgactggcatcttggaaagaccactcgcccacgtttgctggctgatgagctactagttgattcatcaaatcttctgaaatcagggtcctatatggaaacttcgccaccggggtcaggatagctgcctccaagagatgttcataaaccgttgtcagcttgatgtgacgttgagttgcgatggcgtggggatttcgatccgcttgccggacaaacatcttaaaggtggtttgagcactgttggagataattggtttggccaatccggcagtcaatggtgcaaataaactcgtctttcctgcgcgcatgactttttccaggagcatcccatacaactgcagccactgcaattcgataattgtggtcggcacgtggcgtttgactgccacctgctcagctgtcaatcctgagaagtcatgtccaaccaggctttgaacgaagagatcagccagttcatcctggtggaggtcactcaaaaagctgtttaacaattggcggaaatgttccggtagatggtcctgcttatgatcaataaaccagcgttttaacagctgatcttcaaaataattaattgactggggatagtattgattgttaccatagctgaattctgaaacaatttgggtggcaaaactgaaccgccgcatgaatttggccacatcatagcgcgacgaaactgccagggattcgagaggcagcagctgattcaaataagcttgctgctgttcgaccccctttgcagtcaattggattctgaagtcatcatcggcttgagccaacccgttggcagacaactgggccaagactggctggtcttcaccgaagtcggcaccgtggagaacgtcgataaaatcaagcatcccatattccagtgcccagtataaattggaaacagtgcggcgcccccgtaaggtgtttttaatcgccttcacccgccgaaattgccgatcactaccaaaaattaacatgagaatgcctaagtccatgaactacctccgaaacaaaaagccagtccaaacccgcaagtttgtcccagcctctaagattactcactattcaattatactatatcaaacaaattttgaatggttctatccacatttagcgaagttttaagcgtggcaggaaactgttcttgattaggtagaacacaccaccgacgacaattcctttgatgaagttaaatggtacaacaccggacaaaatgacggttgccagtggaaagcctaatttcatgccaatcaggttcatgtataggggaataactcccagccagttggtcaatgacatgataattgtcaaggcaatggccatggtcaaaattaccagccctgctttcttccaccccttggtaaatgagaaaagccggtcagccaggtagtatgcccaaatgagcaccaaagatgaaaccagggatgaaccgacaccaatgaagttaatcacgtcggcaccagtcgttacccagtaaagcaaggccttcaaaccagcaatcgtcatgccgccaaccggtccaaacaagacggttcccagtaaaatcggcatgtctgccaaatccaaccgcatgtaaggcacgattggaataatcggcactgacaaaaacatcaaaacatatgagagtcccgcaaacacggacatctcaaccaaacgcgttgttgcaaactgcgtatgcttaccactattttccattgaaaaaacctctcctccaatggtcaatcttcaaaataatgccctgacaaaaagaatttgtcagggcattacaaaaaatgtaaaatttaatcttctacataccagactttactgtcggcactggaatttcaccagctcagcacgatcactcgtgagtcgcggactatcaccgccggtcgggaatcacaccctgccctgaagataaaccaatttatttaattcaaatatagcagaaccaaggcaaatgtcaacgatttgtcttgcccgtcaattcctttaattcttcgacttcatgtggtttcaacggccgataatcccccggctgcaagcctttcaatgtcaaaaagccataggtttcccggcttaatttttcaactgggtgaccaattttttcaaacatgtttttgacttggtgattccgaccctcatgaatcgtcaattggacaatcgacgagtccttgttggtgcgaatcagcttggtcttggccttggccgtttttcgatgctcgattaccacacccgtccgcaagtgtttgaggtcgtcattggtcacaattcccttgaccttggcgacataggttttttcaacctcgtactttgggtgggttaatttgttgtccaggtcgccatcgttggtcaataataacaggccagacgtgtcatagtccaagcggccgaccggataaattcgttcgggaacctcttctaaaatatcaaccacggtctttcgatgcttgtcatcggttaccgcggtgatgacccctctgggcttgtaaagcaggtaatagactggggcttcttttgaaatcggcacttcatcgactttcacctcatcgtttggggtgactttggttcctagttctttaaccacctcgccattgaccttaacgtgtcctttggcaatcaactcttcagccttccgtcgggacgcaactcccgcgtgtgcaatcactttttgtaaacgttcttcgttcatacatccacctcctaattttctttatcaatctctttgttaaaacgggttaatagtgaatcactggtatcatcatccaagacttcatcctttggcaatggcggcaaatctttcaacgacttcaacccaaaataatccaggccaaaattagtgatcccgtattgtttggggttgccgacctcttctttgaccccagtcacttcaatcaaatcttgattgaccagccggtggagaatcgccgagctattgacccctctgatctgatcaatttcaattctggtaatcggttggttatacataataattgaaatggtttccaatgccgcttccgacagaacccgcggtttggcatcgttgacataatcgcccactagttctgacaattcttccttggttcccagccgatacacattgtcgctgacgaacaccttcaagccgctgtcttgatcttggctatatttttggacaattttttccagcagctgccggcaggcggccaccgttaacgcggtccgctgggacatttgccgcaacgtgatgccttggtcccccgaggcgtaaagcagtgcttcaatttttgccagattactgatcaaggtatccaggcccctttcgaatttcaatggtcgattgtacggttggttgattgagctggacttcgttatacttggccatttccaaaatcgccagaaaatcagtgacgacctcttctgtttgagttgaattggcaaccaatttatcaaaggaaatccggttatcagtttggtttaacagctcgcgcacccgttgactctggccttcgatcgtaaaggaccactcatgaatcaccgtcgacatgggttgattatacttgaagtgtttcaaggcatccacgtagctggccatgatgtcgccgctgttgaacggagatggctgaatcaattccgctttggtcggcgggacgctcaactcggagcgggtaaaactctcccgccgtttcatttcccgctttttcatgctggccgccaccagtttgtaccgcttataattcaacaactgggacactaattcctcacggggatcggcctgctgttcatccggttgatcgtcagtaatcgtcggcagcagcatctttgatttgatgaccatcagcttggcagccatcacaaagtattcgccaacaatttccaaattcaattgctgggcatcatagatatactgcatgtattgctcggtaatctttgaaatctgaatatcataaatatccatcttggattcctgaatcaaatgaaggaggacttccagtggcccgtcaaaatcattcaaatgtaattctggctgcttgacttcaggcatgattaatcgtattctcccatttttcccaggcggctcgattttcaaagccgaccacaatttgatattttggatataaatcctggaggtcgtcaaaaatccggttatagttcccctgactgacgctttgcggggttaacaccaattgatgaaccaacagctggtttccttgaagttcaattccgactaagcccgaccaattattggatgggtcccgccataaataaatcagtcggtcgtctttggcggcgtaccagctcatttcttgggcaaccagatccatgttctgcagttcggaaaccaacgaaaagaggcccatggtgatcttttcataatcttttcggtattgatataacatgtattcaacctctttcgttatgctcgcggatgatatttattataaacttccgttaaatgcttatgagaaacgtgggtgtagatttgagtcgtcgaaatatcggaatgccccaacagttcctgaacgattcttaagtcggccccgttttcaagcaggtgggtcgcaaatgaatgccgcagtgtatgtggtgtgacatggcgtttgatgccggcctggttgacatattttttaatcatctgccagattgcctggcgggtcagttggtgaccgtgggcatttaaaaataggaactctgagttgggccttcccgaaagtagttggacacgcgtcgattgaatgtattgattcaaccagtcgatcgccacgtcgctgatggggatgatccgctctttgtcgcccttcccaattgtctgcagcaagttcatcggcaaatgcaaatcacccaacttcaagttaaccagttcactgacccgcaggccggtggcatacagcgtctctaagatcgcgcggtcgcgcagacctaattttttatgagtatccggcatcgatagtaactgattaacttgggccacagtcaaaacgtccggcagtgtctgggcctttttaggcgaatcaaccttgagcatcggatcgtcaacaatcacgtggaattgaaccaagtactggaagaaccgccgtaatgtcgagaccaccctgataaccgtgttccgggctttatgctgccgttgaagggtttctaaataatccaagatgacaaactggtcaatgtcagcaattgatttggcgtgtttgtcaaaaaaagcaccggcctcctgcagatcctgccgataacttttaattgtattatctgaaaggccgcgttcgacccgtaaataatgaagatagtcctcaatttgttcgtgcatcataaaagcctactttttcaaggaaatgtggccatcagcttgttcgatcaggttttccttcagcagatgtcccaacgcccgtttgaatgcgcctttactgataccaaagtaatctttgatggaatccggcgtacttttatcactgaacgccagttgtttgtcgtcggtatgttcaatggccgccaaaatcatctgagcgtcttcaccaatttcttggtaagcccgtggcttggtggaaatattgacactgccatcccggagcatgccaatcactctggcttcaacttcctgtcccaaacgtggttccatgagtcgttcgtcaggatgcagaaaagccaaattgtaatcctcggtcaacaagcgcgtcccggaaatcttcaggcggtatgcccgagccttaagatttttgttctgcagatcatccttggccggcttggcaattgccgcaaagatttcttcgtcagctaagtgaccccaaattcggttcttgttatccaccgtcaaatcaatcagcagttgatcaccgtcttgcggccacaatgaccggactgtcggcagttcatcaattgagacaacgacgtctttattgggcaggccaatgtcgacaaagacccctaaaccaaatttttccttcacaacggtcgcaaaaccgtaatgatcacgacggatatccggaatgtttctggttatttgcattttatgctgttcattttcatacgtaaaaccagtgaaagacgcaccgattcgcaagggtttcttgagctcagtcttatcaaggagaaatgtttctccttcaatctgaacgtaatagtccttgtcattttcatcgatgaccttaccggttacaacttgcgcaataatattattcatgcttatctccgatctaatcgagcttaatcttattttacacgtttttcagtgaaaattcgaccgcccttatcataacaggaaacaggtccgaacggattaaccgcccggacctgtcatgattaattgtgattactcacaagttaaatttagattgatgatgaagcaccatggtaaataacgccccgatgtgaatcaacggtaatcaattcaccgtcagaaatcttgctggtagcatcagctgcaccaacaacaacggggattcccattgaaataccaacaacagctgcgtgtgaagtcaagccgccggtttcaacaactacggcgcttgccttttcaatagctggtaagtattctttgtcagttgacttagtaaccaagatactgccttcagttactttgctcttggcatcagcagcgtttttagcaacaaccgctttaccaataacagtcttgtcaccaactccttgaccttgaaccagctttgaaccgatcagttggattctcatcaagttggtggtaccactctcaccaacaggaactccggcagtaacgataatcaaatcgccttccttagctaaaccagtttcgagagccttctttgaagctaattcaaagatttcatcagtgctcttaacttcgtcaaccaagattgggtgaacaccccagttaaccatcaaaccgcgacgagtacgttcgtcgaaagtaatggccaggatgtcagcatctggatgatacttggagatcattcgtgcagtgtaaccagaacgggtagctgcaacgatgcagtgaacgcctaattctttggcaacacgggcaactgagtcaccaattgattcagtaacatcacttgagtcaaattctggacgtggggtaccaaattcgctaaaggcattttcagccttaacatcgatacgagccatcgtttgaactgattcaacagggtaatcaccattagcactttcaccagaaagcatcgttgcatcagtaccatcaaagacggcattggcaacatcagaagcttcggcacgagtaggacgtgggttttcctgcattgaatcaagcatttgagtagcggtgataaccggcttgccaagttggttacatttcttgatcaaagtcttttggaccaacggaacgttttctgctggaatttcaacacccatatcaccacgggcaaccattaaaccatcagataccttgatgatatcgtcaaagttgttgataccttcttgtgattcaatcttagggaagatttgaacatgttccatatgcttttcttcaagcaattcacggatgtccaaaacatcttgggctttacgaacgaatgaagcagaaatgaagtcaatgtcattgtccaaaccaaaacgaatatcatctgaatctttttcagtgataccaggcaggttgattgaaacgccgggtgcgttaacacctttacgtgaaccaagagtgctgtcgttttgaacagtgacaactaattctttgttagcatcgtcttttttagtgacaacagtgtccaacaaaccatcatcgaaaagaacatggccgccttcgtgaacatcgtcaaagagtccagggtaagtaaccgcgatcttgtctttagtaccctcaagacttgcgtccattgaaatacggaaaacatcgccagtgtggaattcgatcttgccgtctttttgaacagttgtccgaatttcagcacctttggtatcaagcataattccaacagtcttgccagtcttcttttcagcttcgtgaaccttgttcatacgatcaagatgttcagggtggtcaccatgtgaaaagttaaatcggaaaacattagctccagcttcaatcagcttagtaattgtgtctacatcagtacttgctgggcctaatgtacttacgatcttagttttcttcataagtaaaatctctccttcggtttttgggcacgcaacaccttattaaaatgtcgcaaaacaatttaaataacgcatcggtatccttttagatttcaatcgtattttatcactttttaagcgggttgtcgcccaccttttgggggtaagcgggctttccagcaccgacttggaatggcaaaagttaggtctaccgcaaatgaaagcctttacgtaatgaacctgacttctgaaaaattattccaaaaattcacttataaaccacattattcctgccaaagattgtgattaattgctctttggtttcagaacttggatttagccacagcttgtcctcgagctgccaagtttttttggtttctgtttcaaaaacgataaccgggacctggccgtgatattggctgctcaggtcggccagtttgtgaaacattgtatttttgtcatgttcgcgatcaattcgcaaataccatttagattgctgttttgatcgcttgaggttcatcagggcgttagccgccggctggatgtcattggcgaccacctgaagatcgttgactttctcgacgttacctttgatcaaaatcaccaaatctttgtgaagccatgactgggtcttggtaaataagttgggaaaaacagtcaccgaagtctgccccacctgatcattaccgtctaaaaaggccatttgtttgccggttttggtccgaataatcttaaccttggtaatgtagagaatcaagtaaatatttttcatacctgaactcaacgtagcggttgtctcagcatttaatcgctgtgccaagggggcaaatcgttctgtcggatgaccagataagtaagcccctaaataagcattttctttttccagcttgtccatcagaggcatctcgggcatctttggcattttgggctccaatgctttgaacaagctcatcgaattgccgcttaattcaacggagctgataaattcaggggcggcagcgattaattcggaacggttaaatggaaaaacatccaatgcgccggcataaatcaaggcattgatcaattcaactttgcggtacttgccgggcaggcggctcaaaaagtccggaaacgacttaaatggcccgttttgttgtcgctcagccaataaatccactaccatgtcgtgacgcacgcctttgattgaatcaaggccaaacacaatttgttgatcttgaaaggtaaaccgggcttcactatgattaatatttgggccaacaaccttgacccccattgatttggcagcttggatgtattccttgaccttaaccgaattattgttgaccgaatttaacagggcaacgtgaaattcgcctgggtaataaactttcaagtaggctaattcataagccatcttgctataggcaaccgcatgggatttgttgaagccgtagttggcaaaccgctcgatatagtcaaagaccttattggcgactgaatctgaatatccccgctgtttggcgccggtcatgaactgagccttcatttgttccatcacgccaagctttttcttactcatcgcccgccgtaaaatatcagcttgacctagagagaaaccggccattttggaagcgaccagcatcacttgctcctgatagacaattacgccataagtcggctggagaatatctttgagcgagtcgtccgggtaggttaacgcttcatgattggtttttcgcttaaccacctcatcaatgttctgcatgggtcccggtcgataaagcgcgttgaccagggcaatgtcttcgaaccgttcgggatgcagacgcctcaggacatttcgaatgccgttggactcaaattggaaaatgccagtcgtgtccccgtcggcgaataattgaatcgtcttggcgtcatccaagggcacagcagaaatgtccagaacctttccggtggttagttgaacctgctccagggcatcacccaaaattgacagattccggagtcccagaaaatccattttcaacaacccaaccgattcaacataatctttggaatactgagtcatcaacagcccttcgttgccattttgaagcggcactaaattcaccaggggatcgtcgcttaataccagtccggcagcgtgggtcgaatagtgtcttggcaagccttccagcgcttgggcggtttggtagagtgcttcattgagcggactgtcagccaccagattcttcagtcgctgggaattcgccaaagcgtctttgagggtcacgtgaaatgcgttgggaatggccttactccactgatcttgctgggcagtattcaagccaaacacccggccgacatctctgatcgattgcttcgctgccaaagtgccaaatgtgatgatttgggcaacccgtttgtgaccgtatttttgatggacatattggatgacttcatcgcgtttgtcgtctggaatatccaaatcaatatccggcatctgaacccgttcaggattcaagaaacgttcaaacagcaaatcatatttaattggatcgacgtcggtaatcgttaaggtatacgccactaatgacccagcggccgatccacgcccagggccggtaatgatgtcagtctggtgagcgaaattaatcacatcccaaacaatcaagaagtaattatcaaagcccatcgaatgaatcactgataactcttgatccagccggcgatgataaggggtcgcatctgtaatctgatttttctttagtcgatccgccagtcccgtttcgcaaagctggcgcaggtaagttccggaatcgataccgtttggtgtgtcgaattggggcaatttgggctgctgtttcttaatctcgacattgcaatcagcgacaatttggtcgacttgcgtcagcgcgtcagcgaggtgaacctgacggtattgagcctcaatttgtgtcgccggacgcagccagtagggccccacttgcttactgaattgggccacgttggcgattttttctcccgcgccgatattttttagaacctgcatggaaaaatagtcggtggcgtttaagtattcaactggcgaatccgccaccaaagcaacttgcttgtcagccgccagcttacttaacatgtcatttaagctgtccgaggaatggtagtcgacaccgattttaagggcattaggatcaatcccgagggatttgacctgatcaatcaaatcagcagcgtcatcagcccgcccttgtagaagcaggtcattcatttctgctgccggcggcaaaatcagaactaaatcactcaaatagtcacctaactgagaagctgtcaattcgggcatggtcatctttaatgttgataatttgagaagattggcatatccttgctggtttttggcaatcagcacccacccatattctttatcggtcaaaatcaagccgggcagctgcaaagtcagaccgatcagtggcttaatggcggcctttaaacaagcgtcgtagaattccacggccccatacatcacgttgaggtcagttaacgctaacgcctgataaccgcgatccttggcttcagcaatcaagtccgcaatgcgaatcggactctgcagtaaactgtatgaacttatgacttgcaacggaacataactcacaggattgcccttctttcttaattaaaattataccaaatatatcaagcccacattcaaattggcaaattaaataaatgatgatttttcacaaaatatatgctaaaatgctattgattgtgaggtggcattagacatgaaacttattagttcaaatattgtagctgttttgtgggcatacatctttggagaaatcattggttacataggttccgccctcgaagttcgaacgtgggatccttcccaaatcggaattgctgccgcaattactgcatttattgccgtaaacggtatctatctgatcagcaaggattcagcaacatcaagtaaatcaaaagaatagtttttcgaaacgttaaaaggctatggcagattttgccatagcctttttgttgtctcaatcaactttactggtgtgtgtcaaagaactgcagcagacgttcaaaaacaactttccgatgcgtttcttgaagaacctcatgcttcatatgcggctcttgcagactgatcacatttcgatagccgatcctatgcagcgttgcaaccgtgtctgccaagcccttctgaccaccactgaacttatcttcactgccgaccaaactcagaattggcagttgtggattgtgacagtcaaatttttgaaggcgtttcagggaataatcgccctgccacagtgttaccaaacttttaaccggatattcatccatcattaacggatctgtactgacccggtgaatgtttgcctgattatagctcaaccaggaatgatcccccggagttaggccggaaattttagatagcaaggaccatttagcatcttcagaatggcatttcaaaaagacccaaccaatgaataagccaagcggcaccaccggaatatagttggtggtcccggttaacgcaaccgcattgacttcctggtcgtggtgctgtaaatacaatctcgccaagatagaaccaaaagaatgaccaaacagactgaccggcagattgggataccgggctttgatgaattgggtaaccaacagctgatcatggattaattgcggcagactgcgcatcatcccccaagggtcatcgtcggaaactgattggccgtggccgcgattatctgagatcaccgcaacatagccatggtcactcaaaaaccggcaaaattcataataccgttccttatgctccaaggcgccatgaataagttggacaattccctttggatgatcagcgggaaaatacgccacggctaattgagtttgattttcagttggaagctggtaattaatcggcacaccgaattcctccccaggtagcttggtttaaatctgtgcgtcagcaggtaattgttcaggaacaaagcttaactgatcgttatcaaggttaatgtgaactacgctatgaggcttgatctgatcagccacgatcattcgtgccagcggagtttccacgacgttggtcacataacgctgaagcggtcgagccccatattgcggttcatagccgttattggcaatccagcgtttggcctcgtcagaaattgacaatttgatgtcttgagccttggtacggccagataactgattaatcagcttctggacaatctgttcaatattggccttcgtcaacggtgtaaaggtgatcacatcatcgattcgattcagaaattccggtttgaacgaagcttttaataattggttaacctgctgttgggctttttgggaaataaccccgttctcatcggtgccttcaagcaaaatgtctgaacctaagttagaagtcatgattaaaatggtgtttttaaaatcgatcgtccgtccctgactatccgtcaaacggccgtcatccaagacctgcagcaaaatattaaagacatctggatgtgccttttcaatttcgtcaaataagacaatcgtgtatggattgcgccgcacggcttcagttaactgaccgccttcttcatagccgacgtaccccggagcagcgccgaccaagcgggaaaccgattccttttccatatactcagacatatcaattcgaaccatgtgattttccgaatcaaacaagtcttcagctaaagctttggctaattcggtcttaccgactccggtaggccccaggaacaagaatgaacccagtggcttgcttgggtcttgaaggccagcacgtgagcgaataacggcatctgagacagctgtgactgcagcatcttggccaattacccgtttgtgcagattgtctgccaagtgcagcaatttctttcgttcaccctcgactaatttggtgaccggaatgccggtctctcggctcactaccgccgcaatttcattggcggtaacagattcgctgaccagccaatcggaatgctgatcgttatcttcaagcttcttcaaatcggcttccaactgcggaatggttccgtgctgcaacacggcagcctgatttaaatcataggtgttttccgcctgtttcaattcattcttggcctgatcgagttgtttctttttgtcggaaattttcttaatagcttccttttcctgcgaccaacgggcatttaactggttgactttttccttaatattggccagttcttcttcgacttctttcagccgcttcttggatgcctcatcggtttcctgcttgagagcagcttcttcaacttccaggcgcatcatctggcgctttgattggtcaagttcagttggactggagttcatttcgacccgaatttcagcggaggcttcgtcaaccaaatcaatggctttatccggcaaatagcgatcggtaatataacggtcagatagtttggcagcagccaccaacgcgttgtcatggattctgacgccgtggtgaatttccaaactttcggacaagccacgcagaattgtcaccgtatctccaacggagggttcgtggaccatgacccgttggaaacgacgctcaagagccttgtctttttccatgtacttccggtattcgtcaatcgtggtggccccaattaaatgcaattcgccacgagctaacatcggctttaggatattgccggcatccatactcccctcagctttaccagcaccgacgatgttatgaatctcatcgatgaacatgatgatttggccctcggcttttttgacctcttttaacaccgcctgcaatcgctcttcaaattcgccccggtacttggcgccggcgattaatgatcccatatccaattgaaaaatggttttattcttcaagttttccgggacgtcgttagaggcaattcgcattgccaagccttcaacgaccgccgttttgccgacaccgggcgccccgatcaggaccgggttattcttagtctttcgggaaagaatccgaatcacatcgagaatttcctcgtccctaccgataattggaccgagcttattgtcacgggcagcctggactaaatccgtcccatatttttcaagtgattgataactgtcctcttgattcttggtcgtcaccttttggccgccacgaattttttccacaacgttgcgcaccttttgctcggtaataccttgttgagaaagataatcggcaaatttgtcaccgtgtaactgcatcacagcaatcgttaaggtgtcaacagcgatgtaggtatcgccaaattcatttttaatctgttcagcattctgcaacagttcgtataaattggaagagagtgactgaccataattaatgttgctgccttcaaccgtcgcgatggcatcaatttcagcatccagttcatcattcagatctcccaaattcaatccgagttgagaataaatctctcgggccaactcgccgggttgaaccaagaatttgaataaatgggccacggtaatgttttgctgttttcgagtagccgcaatctgttgggcctgagaaattgcctgcgtgacggcttccgttaaattatcaggattcattaaattatcaccttattaatgtattttagttgactattgtttcaagaattcgttctaataaaaaggttcgaaacaaaaatcattcttttcattccaaaccactaacgctatactatcaaattttgaatgccctgaacaataatttgaccttttttgacctattacttttcagcgtataatttggcgatttccagtaccacgtcaaccgctttttccatggtttgctcagacacgtattcaaaacggccatgcatattctcaccgccagcgaaaatattcggcgtcggcagtcccatgtaagaaatcttagacccgtccgttccgccacgaaccgggaaaacatgcggtgtaacgtcaacgttcttcatcgcctgttcagcaatttttaccggtgttggatcctttttgataatttctcccatgttgtaatactggtccttgatggtcaccttaacccggtcctcaccaaagtcactgttcatctggttggcaatccccttgaaaagtcgttttcgagcttcaaagcgatctcgatcatggtcacggatgatgtagcccatttcggtgtggtcgacggttccctggaaatcatacagatggaagaatccctcccgatcctgggtcttttcaggacggtcaaagtcaggtaaggcggcgtggaaatccattccaacttggatggcattgaccataatacccttggcctcagctggatgaacatcggttcctttgatcacgacttttgcatcggcggcattaaaggtttcgtaattcaaatccccaagtgggccgccatcgacggtgtaagcaacatctgcgccgaaatctttaacgtcaaaatggtcggcgccggtaccaatttcttcatccggaccaaaggcaatcttaatgtcgccatgtttgacttccggatgggcttgtaaataagtgattgcagcaacaatctctgctacgccggctttgtcatcagcacccaacaacgttgacccgtccgtggtaatcagggtttggcctgcatacttcttcaaacttggaaagactttggggtccagcgtatattcacccttctcatcaagtttaatgacagaatggccatcataattctcaacaatttgtggttgaatattttcagcattaaaatcagccgtatcaatatgtgaaatgaagccaacggttggaacggatttgtcgacgtttcctggaagcgtcgcaaagacataggcactttgctcgttggtgtgaacgtcttttaagcccattttagtcagacgatcctttagttgattcaaaaactctgtctctctatcagaggacggaatgctcgttgattgaggatcagaacgggtattaatctttacaaacgttaaaaagttgggaattaattcggcgtattttgccatgacagttatctccttttatctacataaatgtgaatggatcggtattgatggttgactgataaatagccagctgccagtgatactggtcggaccactgtttgaacagctcggccaatttgggaatacaaatactttcaatgtggtggccagggtcgatcaccgggaaattggcagccaacatgtcgtggccggtatgataataaacatccccggtgacatatgcgtcggcgcccttctgctgagccaagtggaagaacttgccgccatcgccaccaagaatggcaactcgtttgatcggctgagccaggtcagaagcgattacccgaaggccggaaaccccaaaggtctgcttacagtcttcagccaattcctggacagacatgctgtgcggcaaatcaccgattcgacccatcgtaaaatggtgcttcttgtcttccaggcgaatcaaattgtaaagtggtttttccagcggatgaacatctgacaaagtcttcagaacttgatgaagatttctttcgggaacttcaaattccaatcgcgagtcttcgatttcatttggttcaccggcagtccccatggttggatcggcgccggccttgggaacatagtagactgtcccgtcaatttcgtaggtgtatccactgtactgagcggcactggcttgcgcaccggcatcgacaagcgacattctaacagccgtcgcatagactttaggcacttgcacggttaatcgaaagaccgattcatcataggcagggaccatcccacttagattgtttaactgaagtgcttcggcaagccaatcattcatcccaccgtcagcagcgtccaaattagtgtgggcagcgtaaacagtgatgtggttggcaattattttagcgtacatcgcattttgcgggtcatcgagatcaagattatgagctggatgaaacatcaccgggtgatgagcaaaaataaagtcaacgtggttggcaatcgcctcatcgacgacttccgggcgaacatccaaagtggtcatgactttgtgaatttcctgattgagtgaaccgatttgtaagccgaccggatcattttccattgccaactttttgggggcaaattgctcaaatctttcaattaactgcttagctttcaaccttgatcacctcattgattagtttaatttctgcctgaatggccgccatttttgccgtatcgggagtggtggcctgacgcatattcttaatcacccgctttagcaggccaatttcttcctgccatttttcaacgaacaccggcgatttttcttgtaataaaaatggaccaaactgaagggccaattttgaataagtgacgggtttggcggcctttttagccgtaatgatttcatagatatggccgtcttcttttaggatctgctcagcaaagattcgatattgattggccatcagccagtttctgacgaccggttcgccgacgttgggttggagaatcaacttttcttttccggttaatttagccttaccagcttccaaaatgtgggtaatcaggttgccacccatgccggcgatggtgatggcatcaatgtcgtcgccgggttcaatggctgccaagccatcggcaagtcggggatgaaggatatccaacaaatggtccttagtaatttctgatgtcgcgttggcaagcggtcctttggcaacctcaccgacgacgccatagtcgataatatgattttgagccaagtgaatcggcaggtaggcatgatccgagccaatatctgccagccggctgccaggttcaacgtggtcactgaccgtttgtagtcgtttcgataaatgcgtgctattcatattttgctcctcattttgtgtataaattcattataaattatcctaatggaaaatgacagattccgagaggcattttacttggaagggccattttagcggacaaaaaaagttggaacaccgaagtgccccaactcgattaatgatcatattaaattaatccaagaaatctttaagctgcttgcttcgtgatgggtgacgcagctttcttaatgccttggcttcaatctgacgaattcgttcgcgagtcacaccaaagactttacccacttcttcaagcgtgcgggtacgaccgtcgtcaagaccaaatcgcaatcgtaacacattttcctcacggtcggttaacgtatcaaggacgctctcgagctgttctttgagtaattcataagccgcatggtcagcaggagaagttgcatcctgatcttcaatgaaatcaccaaggtgactgtcgtcctcttcaccaattggggtttcaagggaaaccggttcttgagcaatctttagaatttctcgaaccttttcagttggcatgtccatctcggcaccaatttcttcaggtaatggctcacggccaagatcctgcagtaattgtcgttgaattcgaatcaacttgttaattgtttcaaccatatgaactggaattcgaattgtccgagcctgatcagcaatcgcacgggtgatagcctgtctaatccaccaagttgcataagtcgagaacttgaatcctttacggtaatcaaacttttcaacggccttcatcaagcccatattaccttcctgaatcagatcaaggaattgcatccctcgaccaacataccgcttggcaattgaaaccaccaaccgtaagttggcttcggcaagttcctgcttggcttcttcgtcaccggcttcaattcgcttggccaatgaaatttcctggtcagcactcagaagtgaaactcgaccaatttctttcaggtacattcggacaggatcgttaattttcacaccagtgggcgcggaaacatcagaaagttccttcttggtcactttcttagccgcaccgatggctcgcggatccggatcgccgttttcatcaacgacactgatcccggagtcctcgatactctccaagaggccttccatatccttttcactcagagaataaggcttttcaatcttcttttccaattcgtcataggtaatatggccaattggcttattagccttaacaatggcgtcaaattccttcttgtatggcttgtcagcttttttggtagtcttggccttagttgtcttcgctttggttgacttggccttggtactggtctttgatgcagtcgttttcttagctgcagttgccttcttagctgtggcagtctttgtttctgttactttatcgtcggtttttttagtagccatcaaaacgcctcctgaagttatacttgttgcttcattctcttctgttgttcaagcttaacaatctcaatcgttaacgcacgttgcttgtcaacatcaccaatcttaacggcttgcttgagttctgcccgctttttctttaacttttcctctaccggggctcgatgcattaaaatgtttaagtagctatcgatttcagcattggtcggattatctggaagctcgagcatgtcaatatcaactaatagactttgcagtgagtcttccgaaatcaggttgctgaacgtggcaacattataatcatcgaatttggtaaaatacccctcggctaaaaggtacaacatttggtactgttcatcaacaaatgcgaaccccgaaacattacttacctttaaccaaatatcatggtagtgcagcatgcggttcatcagctgcatttcggctttctcaactaacgagaaatgcttttgctgtttaacgacctgaacctgcttgtggtattgatgcggttcagccgccggggcgggttgtctgatcaatggtgctaactgctgttgcagcagttgcttggccactgaaaattcatccgccaaccggttaaggtaaagatcccgtgaaatgccggaatccactcggctaatcagctttaaagcttcagcaatgtaattagtttggtcaatctcagaatccaaattgtattgttttttgagataattcaattcaaactcaactggagcctgagcatggtcaatcaactgtttaaaatcgtcggcaccttttttgcgaatgaactcatcaggatccattccatcaggtatcgagatgattttcatcaccaaattgctcttctgttcattgaatgaatcaatggcgcgtttgatcgccttttggccaggcgtatcgccatcataggaaatcacgacttcgcgcgtaatccgtttgatgtcatagatctgctgctcggttaaactggttcccatcgacgcgattccggacttgatccctgcttgaaaggcagtaataacatccatgaatccttcaaataaaattgccggctcaccggtgcgaatatttgacctggccaaatctaggttgaataacacttttcgtttgttgaaaatgtcagtctcaggactgttcaggtacttcggcatgtcggaatcagtggttaacaatcgcccagaaaaagcaatcgtttgaccggaaccgtttcgaatcggatacatcacccggtcgacgaaacggtctcgcaaattgccatcctggtcttcagaaaacagaccagattttcgcagcagttgaaaatcaactttgcgctcgtcgaaaaatggcttcagcaaccgctgtgccggggcatatcccaactgataagtggtaatcgtctggtcggtcaatccacgtttatgcagataatcgagcgctggctggcccatcttggtattggtcaaaatatggtgatacagcttgacgctttgctcgtgcagatcaattaatgctttttgttgtgtgttttcgggacttgattgggaactgccgctttcacggaaatacttctcatcaacagaaatattttccatctcagcgacctttttaactgcctcaggaaaggaaacattctgcagctccataatgaacttaaagacgttaccgcccctgccacagctaaaacaatgaaaaatctgtttatcttccgagacggaaaaagatggggtccgctcttcatgaaacggacaaaggccaaataaattctttccggactgtttcaattgaacaaactgggagacaacgtcaacaatgttaacctgtgacctgatttcttcaatcacatcttctgggatcttcgccattacttcgcctcccatcttcaaaactgaatcaatacctgtaaaaagccgcacccaaaagtgcgacttgttttactggcgatacgtatttaaatattatcataaaacattaattagtacaaatattagccctcaaaattaacctttgacaactaatttatcgagatcaccgagatacataatcatgttggcaatcattgtgagttggcgcaagtgattgttcttcagcttttcatctttggccatgaccatggtggcatcgaaatagtcattaattttatctttgagctgagctaaacgaccaaagtcttcttcggcgctttggtgagtgtaatccttggcagcagctgctacagcctgattcaaagccttctcggaatcattttcaaacaatgccggatcaaccgttaaatcatcagccttgaaggcgcccttcttggcaatccgctgaactcgggtcagcgattcgataatgtccttgaagtcggggtcgtctttatgatcctgcagtgtttttgcactggcaatgttgaacaggatattggtgtgggaaccagaggtcaccgcatcggcaatgtcgtaacgaactcccaagtcgtccaagtactgtttgatccgatctttgacaaagtcactgacggcaggaacttgggctttcatatccagttttggtgcaactgacgcttgatcttctcgatcaattaacagattcaaagtctggtccaaatcaaagtttaactgcttatcagccacaattcgaaccactccggttgcttggcgacggagtgcatacggatcgtttgagccacttgggatcatcccggcagcaaagaacgtcaaaatactgtccagtttgtcagcaattgccaaaattgaaccgacgttggtctttggcagctcaccatttgccgaaattggcatgtaatgttcagaaatcgcggtggcaacagcttgatcttcaccctttaacaaggcatatttgtcgcccatgaccccttggagttctgcaaattcaccaaccattccggtaaccaaatcaaatttgtaaatcgaagcggcccgctcaaggtccttgagctcctgctcggataggccggcgagattcccaaggtgttttgaaatcacttggactcgttgcatcttctcatacattgttgaaatcttatcgtggaagctgactttcttcagccgctcaacgtaatcggcaatcgatttcttttgatcttcttggtagaagaacattgcatcatcgagtctggcagtcaagactttttcgtttccggcaaccacattttgaatatcataatcattaccgttacgaactgagatgaagtgcggcaaaagtttgccgtcttgatcggtcacgtagaagaagcgttgatgatccttcatggaagtgattaggacttcatcagggatggcaaggtatttttcatcaaagttgccaaagaacgcggttggccattcaaccaagttattgacttcttccaataaatcgggatccaggttgatctgccaattgttgtcggcagcaatcttgttaatctgcttggtaattaattccttgcgtttgacggcgtcggcgacgacatactgttcagtcagtttttcttcgtattcgtcggcattggcaagttcaatatccttgcctatgaaacggtgaccagatgtcatccgatccgtgtcgacatccaaaatcttgaagggaatcaccttatcgttcaacaaggccaccagccatttgattgggcggacatattcaaacgaatacgtcccccatttcatcatggttgggaaagtcatggcggtaatgacatccttcatccccggcaaaatttctttaagtgatttaccggcaatgtgtttttcaacgaagacgtactcaacgcccttaacatccttaaaggtgatgtcatcaggagttgcaccctgcccgcgtgagaagccaatcgccgctttggtccaattaccgtcactatcctgggcaatttttttggccggacccttaacagatttgtcaatatcaggctgtttgtcagctaaatcagtaatgtaaagtgccaaacgacggggagtactgaacgttttaatctcagcaaatgaaatccgttgatccttcaagaaatcactggcacgcttctttagttgcttgatgcttggggtgaccacgtgcgccggaatttcttccaatccgatttctaataagaaattattagccattatttctcctccttgtcgtcttttaatagtgcttggcgtttcttttcgtctttaatgagtgggaagccgagtcgtttgcgtgcttccacaaactctttggcaaccgaacgggctaagttgcgaattctggacagatagccggctcgttcagtcactgaaacagcccctctggcatccaacagattaaaagtatggctgcacttgaggatgtaatcataggccgggtgaaccaaatcttggtccaacaggcgtttggcctcacgttcataatcattaaacagggtcaacaacatctcttggttggaaacttcaaaactgtatttggaatgctcatattcaggctctttgaaaatatcaccgtatttaacatcgtcagaccagttcaaatcaaagaccgaattaacgtcttgaacgtatgaagaaaggcgttccaatccgtaagtaatttctgaagcgaccggatccatttccaggccaccaacgatttggaagtaggtgaactgagtgatttccattccgtccagccaaacttcccaaccaacaccggcacagcccatagatgggttttcccagttgtcttcaacaaaccgaatatcatgctccaagggattgattcccaattcttttaaactgttcagatataactcttggatgttttccggagaaggcttcataatcacttggaattgatgatgttgatacaaacggttggggttctcaccataacgaccgtcagccggacgacgagaaggttccacgtaagcggcattccacggttccggaccgattgcccgtaagaaagtataggggctcatggttccagcacccttttcggtatcgtaagcttgcattaacatacatccctgggctgaccaatattgctgcagccgcaggataatctcttgaactgataatttttcagtcataaattttcctcctaattattcaaacgcataaaaaaagtccctatgttcaacgacttatagactaagccactcaacatagggacgatgaaatcgcggttccaccctacttctggtattactaccagcacttaattgttcaactcgaaaagcgccattgacagtaccgacgataatcagctcccactatcctgatttcgctacaagggtccatcctgtcatttcttttgtcatcattgaattatttatttcaaaaataatcatagttgacaatcaaaatattgtcaacgccgttatcagttataatttgaattttcccaactgatcaataaagtgtttactttttggaacgacaccgacacttcttgaataaatctggtcgagaacttcccgcaaagcttttttggtccgatcgttaaccttgatatgggttagtttggataagtcaactaccgaaaacagccgaagatagtaaattgtgcgggcatccaagtgcatccggtatggatccttgttccaatgattctgacacaacagcccaccgtaggcctcagaataatcaaaaggcagatccgttcggtgacagatcgtgcaatccacccaatttggtgcaacgccgtaagcattcagcagctggacctcaaagatattcgtgatgatctgttcatcaaagccttggtcaatcagttgcaggccggtcaacagcttgtcataccaagtggcaatcggctcaccatccggataagccatatcaatcaatgacatgatataagtggcataggcattcttagtgatatcttcactaatgttttggaagtgcactaactgtttatcgttgagaatatacgacaatcctgattctttaatatcgccgccatatagcccgtaggtaaacggcaaaattgctgaacgcatcttgaaccgtgggcgtttggcgcctctaaccaggaacatttttttgccgaattctctggtgagaaattttatcagcaggtcatgttcccgataggcttttgtataaagcaaaatgccattaaaatccgttcgctgaccttttgacaaactgattcacctctaataattatctttgcggtaaccgtaagaattgagcaggttggccttatcgcgccagtgaggttcaactttgacccacagttcgagaaagactttgttgcccatcatattttcgatgtcttttctggcaagtgtcccaattttctttaacatcgagccgcctttaccaatgacaattcccttttggccatcacgttccacaataattgtggcccgaattctcaaaagactgtcttctgtcttgatactttcaatcacgaccgcagttgaatgaggaatttcctggcgggttaattcaagcactttttctcggatcaattctgaaatcacaaatcgttcgggatgatcggttacctcatcagctggataatattgaggtccgttgggcaattctttaattaaggtgtcgatcaattcgggcacattattgccctgaagcgccgagattggataaacatccttgaattccaaggcgttcttgtattgctcgatgatcggcataatgtcatcgggagaaatttcgtcaatcttgttgatcagtagataaattggcttatcaacgtttttcagctggtcgataatgaaattatcccctgcaccgcgatgttcagtggcgttgaccataaacaacaccgcatcaacctcttttaaagcagacaaagctgattccatcatgaaatcaccaagtttgttctgtggtttatgaataccgggggtgtcaataaagacaatttgagcttctttcgtcgtgtaaaccccttgaatcttgtttctggtggtttgcggcttgtcgctcataatcgcaatcttttgaccaatgacccggtttaaaaaagttgatttaccaacgtttggccgaccaacaatggcaataaagcctgaatgaaaatctggattatccatttcttactcctcttaatttaataatgcaatgaatctcgggacaaagatcaacatcccgatgatcacagcaaacagcgctgatagtaacacaccaccagcagcaacatctttcgctcttttggccaaagcgtcaaagtggtgaccaacaatgaggtcaacgacgttttcaacaacggtgtttaagacttccgacccaatcactgagaaaaaagccgcgaacagccagagccactcgttgatgctaatcttcatgacaatggcgaaagttaatacaatgattgccacaaccaagtcaatccgaaaatttcgctcttccaacagcagtcgtttaatgccttcaagagcgtggccgactgattgaagaaacgacttattcttatccaattgtggcttgcggttatcttttgagtccataagcatttaaaatctctttttgaagcggaaacatgacatccgcatcagctttcttcatatgatcgtaaccgttcaggtgtaagaacccatgaacgcacaggaaacccaattcccgttcaaacgagtggccaagataatcggcctgttcggcaactttatcaacggaaacgaagatgtcaccaatattttcaggaattgactctttcaattcttcatccatcacaatggggaaatcatcgtcatcatcgtcatcttcaatggcgaaactaatgacgtcggttgcccgatcgacgccccgatacttcttgttgatttggtgaatttcatcattattgaccagggtcacggacatttcggtattgtcggccaaatgaatgtaagatccggcaaattccaaaacatcccgaatcaatttttgatccttttccgaaacccctttttcagttttatcgtaaatttctaaatccattaatttagttcctcaagtctattcgagattaattgccacttttttcgtaagcggtaatgattttagcaacaactgggtgacggacgacatccttagccgtgaaggttacaaattcaatttgatcaatatccttcaagatcttttgagcggtaatcaatccgctggtcgaatgctttggcaaatcaatttgtgaaatatcaccgttaacgatcatcttcgagccaaatcccaatcgggttaagaacatcttcatctgcatgttggtggtgttttgggcctcatccaagatcacaaaggcattgtccaaagtccgaccacgcatgtaagccagcggcgcgatttcaatcgtcccccggtccatcaatcgttcagtgtgctcggcacccaaaatggcgtgcagggcatcgtaaattggtcgcagataaggatcaaccttttctttcaggtcaccaggcaaaaagcccaaactttcaccagcttcaaccgctggtcgggtaaggacaattttgtcaacggtgcccttcttcaaagccgcgatcgccatgacgacagccaagtaagttttcccggtaccggctgggccaatgccaaaagcgacatcatgatgcttgattgcctgaatatactgccgctgaccaaaggtcttaacgcggaccgccttgccctttgcgtctttgatgagcacttcattgtataaatctttaaagtactccagcgtgccgttttgagccatattcatcgcactgatgaagtcgctgctgttaatattaattcccttttgaattaaagagagaatattctccaaaatgtgtaaggtaatgctaacgggttcatcctgaccagtcactcgaagtgaattaccaaagacattgatggagacatccattccctcttcgataattgtaatgaactcgtcttgagtcccgacaatttgtaataattcgttggggtcggatacaataaactctcttgtaacttgttgagtatcagccaagtaagtgagctccttttttattagtcatattggttcagatattaccacaaagttgtggttatctaaagtatactagctttgcagctgctgcttaaccaatttgttgataacactgccgtcagcttgacctttaacctttggcatgatggcacccatcactttaccaaagtcggccattgattcagcaccaacctgtgaaatagtttcttgaacgattttttcaacttcagcttcggaaagctgttctggtgcatattcctcggcaatctttagtttggcttcctgttcttctgccaaatcttttcggtcagctttttggaattcttccaaggattccttttgctgcttaatttctttcataatgatatcgttaatttgatcttcagttaaatcatgattgccatcggcaactttggcattcatcacctgagccttaatgccccgaatgacacccaagcggaccttatcacgagccttcatggcgtccttcatgtcagaaagcaatttatcatatacactcatcaaagtaacctcttttcgcttaatacttaaattttaacattaaaaaagatcagagactaataaacattagctccgacctttagtcatcatttattaaaaacgacgtttcttcttgttgttacgcttacgtgctgcttcagactttaatttacgcttaacacttggtttttcataaaactctcgtttacgatattcctgtaatgtaccgcttttagaaactgtacgtttgaagcgtcgaagagcatcatcaagagactcgtttttacgaacgactgtctttgccatatgaaattccctccctccgagcttaaatgtaactgtttaatcaacactttaagtgccttctaaaacggttcgaagtaaattatacatattaatcaatacatcgtcaatgatttaagataaaattgatgtgtcatgttaatatttacttaacaaatataattttaggagttatttatcatgaaaactcaaaacatttttattatatcggattcaagcggcgccaccgcccagacaattgcccagacggctttgtcacaatttccagatgtgaaagccgaaattcgccggttcccgtttattcaaaccgactcaattctcaaaggcatcttaaaaattgctctcaacaaacaggcgatgatttttcacacgctggtaagtacggagctcagccagatggttcaagatttctgccgtcaaaatggcatttatgactttgactgcgtccaaacgccaatggcaatgctcagtcaggttactggccaacaaccggctcacgtccctgggttgattcatgatttaaatcaaaattactttgaacggatctctgcgattgaatttgctgtagaaaatgacgacggcaaaaatcccaagggactgctggaagctgacattgtgttgcttggggtttccaggacgtcaaagacgccgctgtcgctttatttggccaaccaaaatcaacgggttgccaatctgccaatcgggccggacctgcaactccctgaagaagtcaacgacatcgataaagataaaatgtttggcctgctgaacacccctgagaaactgagcaaaatccgtaaacaacggatgatttcttacggcttggacgctgatacaccctactcggatccggcccatatcaaaactgaattggcgtacgcgaaaaaattatatcgtcaaattggctgtttaacaatcaacgtggccaacaagtccattgaggaaacggccaccattatcttggaaagcctcaatttaaataccactgaattcgaagattgatttggcctgactagtaaggtcttccagctttcatatcttcaataatattgggattaaactgctgttttttcagcattgcaacttcataaccatgaggattccacttaacgtttttattgtcaggatccttcaaaattggcgtttccataattttgggaacgctttttaattgtgcgtgatgggcaatgtagttcaaggtatcaaaaccaattgttcccaacccaagaatttgatggcggtctttatggctgccctgcggatttttggaatcgttcaggtgaataactttgagccggtcaaggccgatgatgtggtcaaattgattcaagaccccatcaaagtcatttttaatatcataaccggcatcgctggtatgacaggtgtcgaaggtcacggagagtttgtcgttgtcactgaccttatcgataatttcagccaactgctcaaatgacgtcccaacttcggtgcctttgccagccatggtttccaaagcaatttggacgtgctggtccttctcaatcacttcatttaagcccttggcaatttgatcgatcgctttttgcggaccggcaccaacgtgagcgccgggatgaagcacaatttctttagccccaatggcttgtgcacgttgaatttcctgccgcaaaaaatcaacaccaaaactgaaattttccggtttgaaagtgttccccaggttgatgatataaggcgcatggaccacaaccgcttggaggccatgatcggacatatactgcttgccggcatcggcattcaacttctcaatgggtttacgaaccgtattttgcggcgctccggtataaaccataaagacggtttcaccgtaggaagccgcctctttggcagacccgaggaacatgtccttgccgttcatactgacatgagaaccgattaaaaatggtgtttcactcatttgtatatcccccttgtaaaattaattgactgactttttgggaagcctgaccatcttcccaggcacagaatttttggttaaaccgggtcaaattgtcactgaaatcagtaaaagcaccagtttgacggtattcacttaacttttgataaaagtcagtttgattttcaaccattggtcccggcagattagcttgatcgtactgaaagtaaaagccccgcagctgatcacgataatgagccagatcataaggataaaacaggattggccgcttgaggttggcaaaatcaaacatcactgatgaataatcagtaatgagtagatcggttattaagtatagttggttaatgtcgacatcagcgagtattttgacccggtcttcaaacccgctaatatcaatattgtctttaaccaagtagtgtggccgaatgaccagaagcgtttggggatcgacattttcgaaaaattgtgccagatcaaacggcagcgtgaattggtatttccctttctcggaaaaatcgtcatcccgccaggtgggtgcgtacatcatcacctgtttaggctgatagccaaatagggtttgcttgatttttcgaatgtcatcagcgttattttcagtatataaaatatcgtttctgggatagccaatatctaagaattggcctgaatagccaaaagcggatttaaaaatatcgtgtgaatattgatttggcgcaattaaataatcccaccgggcagcctcatcaataaattcctgatgatattcagctgtctggctgccaggaatctcaacgttttcaatatcgattccaagcttctttaacggtgttccatgccaggtttgaatgaaagtggttcgcttatttttgcgccaccactttggcatccgcgaattcatcacccaataatcagccttggcaatgtatttcacccatcccggcgtgaaccgtttgacaaattgaatatttggatactgtttaaccagcctgccgtactcactgggtttgacactgaaatagcaccgctttcgggcagccgggtcatcttggattaattgattgtagatagcaaatggattgtcactgacatctttgccgttaaaactttcaaataacaccgtcccctttttgacgggcatacaaataaacccatcgttcatcacgatgagtacaatgcgggctatgagtttaataagattgatcattgaacgtttcaaaagctcaccctcaaaactagattaaatcaacaaatcgagaacggaatttgtaatgcagatgagaaccaaccaataagaagaagagaatcatgccccaaaagacaatcgtcaaagttggtttctgccagaaccaggcactgcccagcatcccgtcacggaaaccggaaacgacgtagaagaatggatttaactgcagaatatgaacaaacggtgctggaaaggcatccgtctggaaattgaagagaacgcccgacatataaaacagcatccgcatgagtgactgcaacaagatccgataatcgcgaaccaggacggaaattgttgaattaaaaataccaaaagcaatcagccaggcaatcatacaaatgaagtaataaatccactgaatccagtaaattgacggcgtcaccccatataagaagccaatcacaattgaaaagaccagcatggtccaaaaggcacttaagttgctgacaatcttaatggttggcaaaatactgacgggaaatttcattttagaaaccataccaacccgttggtagatactcttggaagcatccaggctggcccggttcataaagaaccaaggtgtaattccgataaccatccaaaccagataatcgacaccatgggtggaattaccgtgtttcaggccgataccgaaaaccagccaataaataccaatttgaatcaatggatataagtattcccaaattaggcccagataatggctttgatactcggctttatcttcatactttgagattcggaagataatgccgatattttgaaattgttctttaattaaagtactgacttctttcaatttgaggcactccttaattagaccctaagaatttgacataacgcgcaatgactctgtcagtcgcctgaccgtcgttataggtgttccaatgggcgttaaatttgtcgaagttaacgcttgtcgctgccaggatttcgtttctgagctgctcgaccttataaaccggctctaccggtagccagttgagaaaatcatcctgaattcctggatcgcttcggtatcgatcaagatcaaacatgaaaaagatgatcgatttggcatttggcaataaactaaaatcaaatgccaccgacgaataatcagtgaccagtgtgtcagccacagctaataaatcactggtctccaattcgtgataaaacttaatcttgggattaccaatacggcgcatcggcacttctttatcccgcaaaacagggtgcagtttgacaaccaccaaggcagttggatctgctgccaaagcactgcccagtcccttgggcagcttaaagtcctgatgctcccgataagttggggcatacaaaatgacccggtgatttttcagttcaggagctgatcgataaattcgctcacgggccttgtgctgccaatcttgactgagatactggtcggatctggggtatcccagtaactgcatcttgtcaaaattttcgtgataactgtgcacaaacacctgtcccattgcttttgatgcgacaatgtattcatcaaagtgatcataaactttctgaaaacggcgcttatcagaacggctgcgtttgtcggtggtcggatcttcccagccaaacttcttaatcgccccgtcagcatgccatatctggacaattttgacgaatggcagcttaaccaggccacccaaaaaagcgtagtagttatcgcaaataatcagctttgctgacatcaaaagcgaaacatcgtccatcacgaatttaatgccatcgcgaaacggccgcgttttaataccaaaggctgctaaatccgtcgcagccgcttcggtattggctcgataaagaacatataaaacgtacttctgaggcagtcgttgtgccaattgcttaatgaagtcaacattatcatcaaagctcatcacataaacaactttgttctttggccgccaaatattcaggactgagaataatttgattaaccataagtaaacaactttcaaaattttcaccgtatttcaatattttgtgatcacacacaaaaaatattataacataatccacttggagaacttgtttcttaggaaatctttaaaaatgccctcagggtttcggctcgtaaaacctccccaaaatcttgaccgaatctgaaatgctggcaaacgcgttggggtcggactccaataaagcttcctccaactcccccatttcatatcgtgaaatgaccgtgaacaagattgttttggcatcgtgttgataagccccttcggcattatgaacgatcgtgattccccgacgaagatggttttgaacactatcgatcaccgtgttggggcgggtggtaataatcatcacctgcattcgctgctgtctggtataggtcatatccatgatgcgcgcattaacgattagactgaggacagagtaaaaggcgtatggccatccatacatgacggcagctgaaacgatgattaacgagttaaaggcaatgttaatcgtcccaatcgagttaccggttcggtgacgaataacaatgcccagaatgtccagcccaccagtcgaaatcccgtttcgaagcgccaacccggtcccaaatccattgacggccccaccaaagattgcacagataatcggatcatgggtgagcggaattggtttgagtaattgaatcataaaactggataaaaagacggtaataattgtgaaaatggtaaattcgtggccaattgcccgccacgacaagacaaataatggcaagttcagcaggaataaagccagcccagttgaaatttcaaacggaaacgcccgcgtactgatggtgttcaacaactgagcgaacccggtaatccccgatgaataaatatgtccaggtgtccagaaaaaattaaccgcaatcgacactaaaattgcgtaaataaatgaagttgaaattttggtgacgtaggtgtgcctacgcattaattttgaaacgtcatccataaaataaatccccttcgaaaactttttgaacgtcttgcctaatgataaacgtaaatgacaaaaattacattaaaaatcctgtaatcagtgactagattacaggattttattgaaatcagttcatttgaaactcgaaactacttttcaccatcaggtttggcaacgaacaagccaagatcttcaagctgtttggtagcaacaggttgtggtgcactggtcagtggctcaactgctttggagttcttagggaaggcaatcacatcacggatgttatcgcgatcagcaagcaaacggacaaagcgatccaggccaatggcgagaccaccatgaggcgggaaaccgtaatccaaagcgttcaggaagtaaccaaattgagcttcggcgctctctttggtaaatccaagtgcttcaaacattttttcttgaagtgcccgggtatggatacggattgatccaccgcctaattcaaggccgttcaaaataatgtcataactttgagcgtaggctttgtgtgggtcttcgccttcattcattaagtaatgaacatcgtcttcatttggcatcgtaaatggatgatgggcagccacgtaacgttttaagtcgacatcccagtcgaataatggccagttaacaatccacaagaaggcaaatttggattcgtcaatcatgtgctgttctttggcaatctcaactcgcagataggccagcgtgttggcaacaacccggctgttatctgcagcaaacagcaatagatcgccaggctttgcttcagccttggctaaaatcttttcacgcagatcggcatccttgaagaatttggcgatcgggccgttaaagccatcatcggtcaccttcaaccaggccaagcccttggctccgaaacgtacaacgtaatcggcaaatttgtccaaatcttttcgggaatacttctcagctccgccgggaacggcaattgccttgacttggccgccatctttgacagcaccggagaaaaccttgaaatcaacatccttcataatgtctgaaagatcttttaattccatgccaaagcgaacatcgggttgatcggttccataacgagccattgactcgtcccaatccattcgtttgaatggcagctgaacgtcgatgcccatggcgtctttcatgaccttggcaatgaatccttcagtgacatcttcgatttcttcttgatcggcaaatgacatttccatatcaatttgggtaaattctggttgacgatcaccacgcaagtcctcatcacgataacaacgcgcaatttgatagtatttatcaaaaccggcacccatcaataactgcttaaattgctggggtgattgtggcaaagcgtaaaaggaaccaggatagacccgtgaaggaaccagataatctcgagccccttcaggagttgacttcgtcagtgttggggtttcgatatcaatgaaatcattttggtcgaagtaactgtgaatcgactgaataatccggtttcgcagcaaaatgtttttttgcatctcagggcggcgaagatccaagtaacggtacttgagcttcaggtcctcggaaacgttaatgccgtcttggatataaaatggcggtgtcttagcggtggccaaaatcttggcatcggtgatgtcaacttcaatcttaccggttttcatcttagggttgatttctttaggatcccgggcaacaactttacccttggcttccacaacgtactcactgcgcagtttatcggcaactgctaaagcatcttggccaaattcctcactgaatactaactgaacaattccttcacgatcacgcagttcaataaaaattaagccgccgaggtcacgacgtttttggacccagccttttaagacaacttcttggccgatgagctgttcatcaacaaggccagcataagtagttctcttcatgtctaatcaatctcctcatcatctgtaaaatatttggtaatgatctcatcaaaatctttgaaaatctcagccagcggtactgaaacctcggtcccggtccgcatctgtttgacgttcgcggtctttttttccagttcactttcaccaatggtaattgtgtactgagcattcagcttattggcagttttaaactgcgcttttggtttgcggtcaaggtaatcacggtcagctgcgaaaccgtctgcccgcaatgcttgaacgatttgtaaggtcaaaacactggtctgttcgccaatcccaactacgtaagcatccaattggtcaagaaccgggaatttaaccccttgggcttccatcaaaagcatcagccgttccatcccaagaccaaaaccgattccgggcatttcagggccgccaagctgctcaaccaagccattgtatcgaccgccggcacaaatggttgtatagccttcgcccaaggccttggaatcaaccatgatttcaaaaatcgtgtggttgtagtaatccaggccccgaaccatatcagggtcaacgacatacggaatgttgagtgattccaaaaggtgtttgaccttatcaaagtgcttttgggaatcttcattcaagtagtccaaaattgatggcgcacccttgacgatttcctggtcgcgtttgtctttgctgtccaatacccgcaacgggttcttgtgcagacgaaccttggaatcatcactcaactcatcaaagtgcgggtcaagatagtcaatcaacgcttgacgatatgcgtcacgggaggctttatcacccagactattaatttccaaccggaggccagacaagccaaagtgtttcagcaaatccatccccatggcaatcacttcgacgtccaattcgggctcattactaccaaaagcttctaccccaatttggtgaaattcacgctggcggccggactgtggccgttcatagcgaaacatcgaccccatataaaagactttgactgggcggggatgttcaggcccgtaaagcttattttcgacaaatgcccgcacaacaccggcggtcccttcagggcgtaaactcatgtgccggtcgcccttatcattgaaatcatacatttcttttgtgacaacgtcggaagtatcaccagacgttctggaaaagacatcaaaattttcaaacattggtgtccgaatctcctgataacgataatcgtcaaacagcatccgggcagtctcttcgacatagttccatttttgagcttcacctggcaaaatatcggccgttccttttggtcgttgatatcgcataattgtttcctcccacttaaattccgaaaaaaaagacccctgtccatagacaagggtgcattcgcacggtaccaccttaattaattctcaaggataacgctcgcacgaatagcatttcgctattaaccatcataagcaaaaagtgtcacttcaaaataatcgacgcatccttccaccaaatgaatgctctctgtatgccgcttatttcgatagttctttttatcggttggatatttaactgtctataagactagtgtaccagccagaaaatgtcaagggaacatcggcgttatttccattcagactggcctctcaggcttatttcaactataatatgattatttgagtgagggaacgattgaactgtgaaaaaaatttgggaaaacaaaagctggattgttgccaccctgacgatcatcatcacatttttggtgttgatcgtctcgctggaatccaattcagtgactgttaaggtcaatcaattaaatattcgaagcgggccagacgttacctactcggtaaaagccaaagttcagcatggacagcgattgcaggtgattagtcgaaaaagtaactggatcaaggtcatctataagcatcgcaccattggctgggtagcgtcctggctggttcaaaacagcaacgttcaaaatgtcagcagcttatcggaagcgacaattgttttggatccgggccacggcggatcggatacgggggcactgtcaatgaccgggcaacccgaaaaacggtacactttggaagttgccaaacgagtcgaacgactgctccaggcgagaggtgcccgggtcgtcatgacgcgcagttccgataaaaccgtcccactagcggccaggccggaaattgccaattcatcatcggccaacctcttcgtcagtttccactttgactcttcggatgagaacaacgttgcgtctggctacacctgttacttttaccatagcggcgactccaaacatttggcagaatcagtcaaccagcagatgaaaaatctgccgttaagttcgcggggcgtggaattcggtaacttcttggtaatccgggacaactcggttccagctattttgattgagggcggctacatcaataccaaaaaagactttaaccaaattcaaaagccggcctatcaaaaaaagcttgcgaaagacgttgtcgacggcatcgcaaactattttaaaaacaatcattaattatttgttggtcaaccatgggacgagttcattgatttcggtgacccgaatctcgggattgccggaatcaatgattgtgccatcaggatcaaacaaacacgaagcgatatttgcattgtggcccgcagcaacatccaacttgcggtcaccaatcatgatcgctttttttctgtctacctgattggtcttaattaaccagttaattgaatcaggctgtggtttccgcggaaaattctgatccgatgtgacaaagccgctgaaatcgtccagcagatcaaactttctcagcatgcttttagcctggtcatccctgtgtgtcagcaaaaagttgcgtcccttcattgatttagccaattccaaaacctctttaacactgggaaacggcagggcatcttcgaccaatttggtttgatgggtgcgattcaattttcgaagctgtttttcatcaatcccataaaaggccgagaactttcgaatggctgtcccaacgtcgtgttggcgcatggtgacataaatctggtcttgatcgatttcaacatcgtcaattcctaaatcacccaatgcttggacaaacgcggaaaccatttttggataggtatcgaacaacgtgccgtcaaaatcccaaaataattgattaatcatttcgttactccttaaaaaagccgaaccacacgattcgactttatttttatctgatcattttttatttgttatccgtatcaaagataatcgtcactggaccatcattttgaatattcaccagcatatcggctccaaaaacgcccgtttgaacttccaaaccggtctgccgcagacgttcattgagttgctcatacacccgatcagcgtgttgcggttcgcctgccttggtaaagctggggcgattcccctttttggtatctgcatataaggtgaactgcgaaatcgacaaaattgcgccattcacggcattgatgtccaaattgagtttaccggcatcatcttcaaatacccgcagtttactaatcttatgggttaaatagtcaacttctgcctcaccgtcggcatcgctgacaccaaccagcagaacgaatcccctgccaattttgccatgaatctgaccgtcaatactgaccgacgcttccttgactcgttgcaaaaccactttcatccagcaaaactcctatctgaattttcgttcaactaaataaacatcgtgaacgttcttaattgccccaatcaaccgctccagctgctccaaattgcggacgccaactgaaagggagatggtggccatcttattattatcgacctgaccattaactgacgaaacgttcttcgtgacactattaacggcggtcaagacattcgtcagcaggccggcccgattatatccttggacggccaaactggcatcataaatcgtccgttcctcaggattgtcagcccaggcgacctcaatcagccgctcaccgttttcttccgcagttttaatgttcgggcagtcaacccggtggattgacacgccgcgtcccttggtgatgtaaccgacaatttcatcgccgggaaccggggtacagcagtgactcaatcgcactaggagattatcgacgccttcgatcacgataccatttgaggacttgcgttttttctgcttcttagcgctgtcggaatcttcagaaatggtctgatggccttccaaaacttctcgttcagcttggtcctgacgctcttttttgagttgggcccgggcatcctctgtcaatcggttaaccaccccggtcggctgcaaatccccaaagccgaccgcagccaacaaatcatcagcgtgttggtaatgcatgttaacggctgccttggtcaatttatccggtaccatgatccggttgggctcaaacccggcttcccgtagtcttctggaaatcaggttcttaccgtcctcaatgtttttctcacggtcttcttgtctgaagtactgtttaatcttatttcgtgcccgcctggtgtgaaccagcttcagccaatcacgactcgggccggctgaaccagtggcagtaataatatcgacaatgtcaccatttttaacttggtgatccagagggacaatcttgccgttgacccgggcaccagtggtgtgattaccaacctcggtatgaatcatgtaggccatatcaagcggaccggctccttttggcagctcataaacgtcgcccttaggggtaaagacatagacgtggtcgccaaacaattcacctttgacactatccatgaaatcggcggcatcgtcggtatcttcctggagttcgataatttgcttaaaccagttgagtttattgttatcctgcgaggttttgaccccgtttgtgattccctctttgtaggcccagtgagcagcaataccaaattcagccacgcggtgcatctcttcggttcgaatctggacttccaaaggcttgccttccgggccaataacggtcgtatgcagcgattgatacatgttggctttgggcattgcaatatagtctttaaaccggccaggcatgggtttccactctgaatggatggcgcccaaaacggcgtaacagtctttaattgaatcaacaattacccgaatggccaacaggtcataaatttgactaaattgtttgtgcttttcaaccatttttcggtaaacggaatagatgtgcttgggtcggccataaatctcagccttgacgcccaatgcagaaatcgcctttttgacctctttgatggctttttcaatataatccacccgttgatcacgacgtgaattcatcaagtgcacaatgcggtagtattgctggggattgagataccgaagtgaaatgtcttccagttcccatttgatggttccaatacctaatcgatcggcaatcggggcgtaaatctccaaggtttcactggcaatccgccgctgcttgtcaggccgcagtgattttaatgtccgcatgttgtgcaggcgatcagccagcttgacaatcatcactctgatgtctttacacattgccagcaaaagcttacggtggttctcagccaatcgttcttcgctggatttatatttaatcttggacagtttggtaaccccgtcgacaatcaaggcgatatcgtggccaaacagctcttggatgtcgcctaaggtagccccggtatcttcgactacatcatgaagaaaaccggctgagacggtctcaggatccatatgcaggtcagctaaaataccagccacctgagtcggatgggtaatatagggctcaccagactgccgtttttggtactggtgagcaatttttgcaaattggtaagcttttcgaatctcatcaacatgttccttgttcatatactcagaaaccttattaatgacatcgtccggtgtccaaattttagtcgccattgtatcaactcttctctcatttgcccaaaggcatcatcaaatcatctttatcataataatatcattgttgtcaaagttattcagcaaactaaatcagttcggtcagcgttgaaacggcactgagaaagtacagtggggctgtttcagtccgcaaaatccgtggcccaagaccagctaacacaaagtcgtgatcgactaattgggtaacttcagccggactaacgccgccttccggaccgaagacagccgccatggtgccgcctgaagcagtttgcctgacggccttcaccaaattggtttcctcgccttgcttggcggactcctcataagcgaccaattgggtatcaaaatctaattggaataaagcatctaatccgcttaaataagccactgttggcacgacgtttcgatgagactgctcagcagcgctcaacgcaacttcattcagccgggtaatttttttagttgctttttgatcccatttaacaatcgaccagtccatcggcaggaaaatcacgtgagccacaccaagttcagtagccttttgaacaatccattcgggcttgttgcccttggacagaccactgacaatcgtgacatcgaccggcaattcaacgttgtgatcaagtggcttgataatattggcggcgacttggtttccctccagtcgaccaatttcagcctcgtacacctggtggtcatcgccaaccagttcaaaccggtcaccaacttcggcacgcaaaactctgcataaatgatgagaaattgttttgggaagttcaatcgactgtcccacagttaaatgttcacttacaaaatagtgttgcattatttgtcctcatcctttggcttttgggcgatgaccccataccaatctttcattctcaaggtttcaatgatttgaaattcttgtgaggtcatcgcattttcaacggttgcaaatttgtccttgataatcccggatgtgaggaaaaagccaccaggaacgagattatcccatgcttggggaaccagcggcacgataatttcggccaaaatgttggcaaccacgatatcaacttgagtgtgaattccggccagcaggtcgtttgccgcgacgtggattcctttagcacctggattgagttgaatgttcttttctgcagattcaacagcgatgtcgtcaacgtcgaacgcgtggatttcccccgcgcccatcaacttggcggcgatgcttaaaacaccggaaccagtgccgacatccagaattgattcgccgccctgcatgaccatttccaaagcctgaagtgatagtcgggtagttggatgggttccagttccaaaggccattccaggatccaagcggacaattttttcctgagcggattttggctgatagtcttcccaactgggaacaatggtgatgaatcgcgaaattgatactggatggtaatacttctcccaggcagtttgccaatcttgattcacgactggcgtcaggtgaacttctgctggtccgggattcaaatcaaacttcgccaaacctcggaccttggtggcaatttggtctgcttgggcatcaatatgctgattgttgggataataagcggatacaatcgccccctgcctaacgtgagtcaggtctttaggatcgacaatttcaccatgatctccgtagcggccgggttttaatttctcaaaatctttggcatcttcgattgaaaccccggtcgccccgtatgccatcaaaatgttggcaacggcctcaaccgcttcacttgtcgtcataattgataattctgtccagtccatggaattctcctttgtcggttgattctaaaatgaaagctggcttcaccccacaatgaggcaaaaaccagctttgatttcgaatccatatcacttagatgcaccatctgatatttcatgttgtttttctttctcacgcgcacggacctttgcctcgtgcttcaataggtgtccttccaagtagttcaatagttcggattcgttctcgaaaatccggggatgcttttgcttatgcagccgtaaatcaatttcgttgattcgctgtctgccagtccacttatgactgtagcgaataataagccggttatccaagcggtcgcggccaaatctgaaaatataaatattatccggtgtcagtaagggccgaatatattcttttttatagaagtaaccgttttttcttaaatattgttttgttcgacttagaatcattaacacctcccagcttattaaattttaatttttcgaatcgaataaaaaaacaattaatatatataataattgaatgtgagaagaaacgcaaacattttctcataatgaatcaaagttgcactccttaacaagtttagcatatgatgtaggaaaggagctgagaataatggaattattccgcattcgatttatcaataagattcgacccgacacgattgagattcgctaccgggcagtgttggaatcacattcaagtgatacggtttttgagggccatcagttattcctaagaagttatttggataccaccattttgaaatcaggtgaagtcgcccttaaagcaatttataatattttttctgccactccaaaagacttggtcttggatcaagtggcttttgaacagtcgcatgaccgaagcctcctgcaggtcccaaccaagcagttctttgatcaatacgtcatcgataatggcatgttgggtcgcgtcgttcaccaccagggagaggacggcaagccggttatcgataccaaattagtcaccgaattgcggattggttagcagacacaccgctattgagatagcgaaaaatttgacaattatatgtcacttgtcatatggtaaatgtgacaagatatacatacgccgaagcaacctttttatcatcaaattctaaatttccgggggaatgaatatggatgcaagacaaaaggttcaagctgtcctcgacagtgaagacagtgcctatcagatccagaagttgaccggggtgaactcatcaattatcatccgactcagaaatcacacgcgactggtggataacttatcactggggacggttgaaaaactggaacggtattttgattaccatgtcaaacacgaaaatgatgacctgcctcattcggtacagttatcccattttcgtcatcgactcattaatctcctgcaggagttataccaaatgcaacaggccaaggctgaggccacaaatgccctgccggacgaaaaagctatgacagcggccattgaacagttatttaacgatgttatcgccaacaagctggagctggaacacttagagaccatttacagccgcgcgttatctgatagtacacaattaacgagtccaacaaaatagtttgaagacatctgatcgcaacgagttatttcgctgcggtcttttttgacgtcataaaggctgtctcaatagaaaaggcgcctagtaagacgtcttttaaataccaaaattatcttaatttagtgtcgcaaccatcaaccaacgctcccgtttactcaaacgaagtgtcgttgctaacaagcatcgcctgcctgaaacgaatcagtgatttgatttcctcaatatcactggctgttgcttgcttttttatgaaatttctagctgtactacggttcctcaggtaacgggcatgggcaagggttattgacctgaataaataattgtcgttaagaccaatggtccagtaaaagtacctatttgtcgcctttttcttcctcatcagtctgcaaaacagccataaaggcctcctgaggaatatccacttttccaacagccttcatccgctttttaccaaccttttgcttctccaagagtttcatccgccgggttcgatcaccaccatataacttggcggtcacatccttgcgataggccttaatattggttctggcaataattttggcgccaatggctgcttggacgggaatttcaaagttctgtcggggaatgatattcttgagtttaccaacgatgtcccgagctcttggtgcggcaaattgacggtgagaaatgaagcttaaagcatccaccttttcaccattcagcaaaatatcaattttgaccaggtcgctgggtttgtagtcctccaactcgtagtcaagggatgcatagcctttggtgctggattttaatttgtcaaagaaatcaaagataatttcggataaaggcatgtgataaatcacgttgacccgatactcatcaaggtattccattgtgtcaaattcaccccgtcgtctttgacaaagttccataactgggccgacataatcattgggtaccataatggttgctttgacgtatggctcagaaatttgcttgatagcagaaacatccggcatttcagatggattttcaacttctttggactcgccatccgttagcttgacctcataggttactgatggtgccgtggtgatcagctccagattaaattcccgttccaaacgttcctgaaccacgtccatatgcagcaggcccaagaatccgcaacgaaaaccaaatcccagcgccttggaaatttccggttcaaactccagtgctgcatcattcaacttcaatttttccaatgcttcacgtaaatcgtcaaacttggcattgtcagttggataaagtccggcataaaccatcgggtgcatttcccgataacccgggagtgcttcatctgcaggatcaagggcattggtgacggtatcaccaactcgggtttgggtaatatctttgatgctggcggtgatgtaaccaacgtctccagacatcagatagtcgcgtttaacaggtttaggcgagttaacccccacttcagtgacttcatattcactgccgctgttcatcattttgatcttgtcaccgggtttaacagtgccttcgaataaacggacacttaaaacgactccacggtaatcatcataaaccgagtcaaagaccagggcctttaggggtccttcaacgtctccgtcgggcgcgggaattttgtggacaatttgttccaacaattctggtacaccgatccccttttttgcgctggccagaacggcatcagaggcatccaagccaatcacgttttcgatttcttctcggaccttttccggttcagccgagggcaaatcaatcttattaatgactggcacaatttccaaattgtcatcaatcgccagataaacgttcgccagtgtctgagcttcgactccctgtgctgcatcgacaaccaggacggcaccctcacaggcagccagacttcgagaaacttcataggagaagtcaacgtgtcctggggtatcaatcaaatgaaactcatagtcgtggccgtctttggcatgatacgtcaattccacggcgtttaatttgatcgtaatgccccgctcacgttcgaggtccatgttatccagtaattgatctttcatatcccgcttggcaacggtatccgtcatttccagaattcgatcggctaaggtcgatttcccatggtcgatgtgagcaacgatggaaaagtttcgaatatatttttggtgattcttcattttatctaaatccatgttgtattctcactttcatttgtttactgataataattataccagccattccagtttatccaaagttaaacggaaccagcagggttgccttgacataaaaagaggtcaagcaacggcaaaacagccggctgacccctccacatgatcatgttatttatcaaaagcatctttcatcttgtcaaaaaaattactaccgcccttgccagcaatgttgtcaccactggccttggcgaatgcttccaaggcaatcttttgattcttattaagcgacttgggtgtaaccacattaacggtcacccgctcgtcgccattaccgttaccacgaaggcgaggcgcacccttacctttgagacggaaagttgtcccggtctgggttccggctggtacctttaactcaacatcgccatgaaccgttttgactttgatcttgccaccaagtgctgctctggcaaaagtgatgggctggtcaacgtagattgttgacccatcacgcgtaaagtctttgctgggtttgactcggaagacaatgtataagtcaccgtaaggaccaccattgtccccggcttcaccttggccttgaagacgcatttgctgaccgtcatcaattccggctggtacgttgacttcaagttcgtgacgctcatcagttttaccactaccgccacaggttgggcacttttccttgatttctttaccagtcccatgacaaaccgggcaaacttgacgggattgcattctgccaagtggggtgttggtctcagtggtaacgtaaccacggccgccacagttggaacaagtgactggtgaagtaccaggcttggcacccgtcccgccacaagtcttacactgggcttcacggttgtacttgatcacggtcttcttaccgaaaatggcttcctcaaattcaagggtcatctggtattgaagatcacggccctgttggggtgcggacggatctgcccgctgttggccgccaccaaagaactgactgaaaatgtcatcaaaaccaaatccaccagcgctaccgccaaagttaccaaagcccccgccttggctaccgccgccaaagccggcaccggcaccatcagctgaaccgtattggtcatagttggcgcgcttttgtgggtcactcaatgtctcatatgcttcattgatttccttaaattttgcttcagcatccggcgctttattgatatctggatgccactttttagaaagcttacgataggcgtgtttgatttcgtcatcgctggcgtccttggaaactccaagaatatcataataatctttttctgccattagaaactcccatcctcattcaattcattaaccatgataatataccatattttaacaaaaagccaaagccagccggccttgacttctcattacaatatctgattataaattactttttatcatcatcgtgaacttcgtggaagtcgccgtcaacggtgccgtcgtcacctttgccgtcggatttgtcatcagttgaaccacccttggcaccttcgccggcagcagcaccgccgtctttaggagcctgttgttgatacagcttgacagccaaatcttgaacaatcttgttcaaatcgtccttcttagacttcatttcgtcaacgttattgtcttccttagctttcttgagggcatcacgtgcatcttcagccttcttgatttcgtcatcggaaaccttacccttgacgtctttgagagtcttgtcagtctggaagatcaattggtcgacttcgttgttcaaatcagctgattccttacgttgcttatcagcctcttcgttttctttagcttccttcatcatcttttgaatctcttcatcggaaaggcctgatgaatctttgatggtgatcttctgctctttaccggttcccttatccttggcagaaacgttcacaatgccgttcttgtcaatatcaaacttaacttcgatttgaggaaccccacgaggagcagccggaatgtcagtcaactggaattgacccaacgtcttgtcgtcagcagccattggacgttcaccttgaagaacgtgaatgtctacggcaggttggttatcagcagccgttgagaagacttgtgacttgctggtaggaatggtcgtgttgcgatcgatcagcttggtgaagacaccacccatggtttcaatacccaatgacaatggggtaacatcaagcaagacaacgtctttaacatcaccggtgatcacaccaccttgaacagcggcacccaaagcaacggcttcatcagggttgattgagtggtttgaatctttaccagtccatgatttgacggcttcttggacggcaggaattcgagttgaaccaccgtttaagatcacttgatcaatgtctgaagtacttaatttggcatctttcaaggcattatcaaatgggaccttggtcttggcaaccaagtcggcagtcaattcgttaaacttggcacgagtcaaggttgtttgcagatgcaatggaccgttgtcaccggccgaaataaatggcaaactgatttctgattcagtaacaccagagagatccttcttggccttttcagcggcatccttcaaacgttgcaaagccatcttatctttggataagtcaacgccattatccttcttgaaaccgtcaaccaaccagtcaataattcgttggtcaaagtcatcaccaccaagatgtgtatcaccattggttgagagaacttggaagacaccgtcacccaattcaaggatggaaacatcaaacgtcccaccacctaaatcgtaaaccagaatcttttcatctttctcctgtttgtccaaaccatatgccaatgcagcggcagttggttcgttgatgattcgcttaacgtttaaaccggcaattttaccagcatctttagtcgcttgacgctgtgcatcattgaagtaggcaggaacagtgataacggcattttcaaccttgtcacctaaataatcttcagcaaagtccttgatgtactgtaaaatcatcgcagaaatttgttgaggggtgtatttcttgccttcaatgtcaacagtgtaaccttgttcacccatgtgactcttgattgagcgaaccgtgttagggttggtgatttcttgtcgcttggcaacttcaccaacttgtggctgaccatctttaaatgcaacaactgatggtgtcgtacgggcaccttccgggtttggaataattttaggcgcgctgccttcaagaacagcaacggcagagttagtagttcctaaatcaataccaataattttattacttgccataaataatcctctttttcttttaaagttttattttgctacaacaaccatcgctggtcgaagcactcggtccttcaaacgatatccgtcttggaggacctgaacaaccgtgtcagctggatgatcatcatctgccggcgccgtttgaacagcctgatcgaatttgggatcaaatggtttgttcaacgcatcaatcacctcaacgccattatcagacaaagccttggtgaaatgctcgtaaaccattgaaaccccctgcttaagttgcttgccgctttcgtcagtgacatcaactttaagtgctcgctgcaggttatcaacaatgggcaggatatcatgggccagctgctggccgtcatacttgattaaatcagcctgttccttcttggcatgggtttcaatatttcgcatatcggcttccgcacgaaggaacttatcttccattgcatcaagtttcttttgtaaatcgactaccgtttgtttcaactttttaatatcatttgcgtctgggcttttggcctgatcagcctttttttccggcttagctgcctttttggctgccttggctggttgagttgattggtcctgtgttggcccacttggattcttcttaaccgaatcatctttgttttctgccaaacaatcgcctccttaaattattgattatcgtcatcgtagtagccaagtaacttcttggtcaattcttcccgcaaagcaccaacaattccgatgacctttgagtaaggcattctggttggtccaatgactgcaatcacgccatgaccatactctttcaaatcataagttcctgtgataatactataatcttttaacaggtcgttgcgcagctcgccgccaattctgacctgaacatctttagagttgggatcaataatctttgaaaccgagtcctcggtgcccagtaaattgtagagtggcttaagccggtcaacattttgccgttccgcaaacttcaatagattcagttcaccatcaacgtgaactttatctcggcccgcttcgtccagcatgtccccgaagatcttcaagaagccttcgggggtctgaatatatttggtcatcaacattggaatatcaaattttaacttgtccatgacatccttgagcggcttgccgaccagttcgctgttaatgatattcacaatggtttcaagttgctcggacgagacgttggccagcctgaaaatcttatcaatgacgtgacctgtgttggtaacgatgatggccattacctgacgatcatccaacttgaccaaccggaaaccgccaagtttcaagttatcgccagactctggattaaaagtcagcgccatgtaatttgtcaaatctgacaatactttggctgactcctggacaatctcgtcaatccgattgaactcactgttaaaagaagttttgattaagtcttccgcaccttcgtccagcgggtccggctgaacgaggttatcaacatagtaacgataaccttcgatcgatggaacccgtccggaagaaaagtgagtcttcgtaattaagccctttgattcaagtgcagccatatcatttctgaccgtcgcggaactaacgtgggtcggaaactcctcagccaatgccttggaaccaactggcattcccgttcttgtgtaatcacgaatgattatttgaagaatatctttttgcctatccgttagcacccaaatcacctctttttagcactcaatatagccgagtgctaaggcacatttataatttaacaaaccgtctgttataagtcaagggaatatagccttattttagcattattttgtgtagagtgctaatagtgctaattcaagatctcaggatgctgctctaagtactcacgggtcgcaactttgtctttatccaactgatcaattaaatcttcaggagtctgaaatttgatctcagctcttaagtatgaaagccagttcacgttgacgacttcaccatagatgttgcggtcaaaatccatcaaattgatttccaccgtcatcggatgaacatccgagaaggtcacattcttgccgattgaagccattcccaagtactttttgtcggcaatttcgacggtaaccacgtagattccaatcgttggcagccattgatattctgagtgttcaacgttggcagttggatagcccaacagtcgcccccgctcctcgccgtggacaatgacgccacgggtttgaaatgggcgccccaacaatttggtaacactatcaacgtcacctgaatccaattcaatccgaatccgggtcgaactgacctttttatcattaatgtcgacagacggcactgtgatgacgtcaaaagcccctttaacaaatttggggaaattggccatcgtggccacttttttatcaccataggtgtgatcaaaaccagccacgactgccactgcattgaaccgcttgagaaagttgttgataaattcttccggagtttgactttgaaaatcatacgaataattcaccagaaagacttggtcaacaccaaaatctcttagcagctgcattttataatcattcagcgtcaaatatcgctgttcatggggcgacatttttcggtagacaattgccggatgatgatcgtatgtcaacaccgccaacttggcaccgcgcttttcagcctcggtttttgcccgttgtaaaactgcttggtgacctttatgaaagccatcaaaaaatcccattgcaacgacagtcgggccatcgaccttaaaatcatcagacaacggatagtgtaatcttgaaatttgcattgttaaaaaccaccttcattaagctaaaaacattctaaacggtctgtattgaccgatttgttcatccaatcggtataacgctttcacctgttgttgataatctaatcgaaccaccggcgcgtgggtgggactgattgattggtccaagaagccaccatgagaaacgattgaccagcggctgtcgtccaattgataaccgggatattccgccagtgcttcagataacggatgaaggacgatactcaggtcttccgcagcaacggcttctttgacttgagccaaagtggatgtctgtgaaatatcaaaaccaccgcttttaattctggtcagatcagacatgacagacggcaagccaacccgttttccaaaatctactgccagcgttctaacgtaagtcccctttgaacagccgacttcaaaatagattgtctgcgtgtgggcagcgtcatcatacgttgccggcttaatttgcttaaaataatcaatatgaatcggacgtggatcccggtcaatggtgatccccttgcgcgcatattcatagagcttgtggccattgactttgacggccgaatacatcggcggcgtctgcagaatgtcaccggtcaattgagccagagcggcgttaatctgttcatccgtcagcggcgttttaaccggcacctgttcaatcaagtgaccgtccagatcctcactatcataagcaactcccagggtaatcgcaccgcgatatacttttccggactgcattaacagttcactgatcttggtcgcctggccgatacaaattggcagcaccccatcgacatttggatccaaggtgccggtatggccaacttttttggtgtgcaaaatttttcttaacttgctgatgcagtcgtgacttgtcatgccacgttctttatatagtgcaattacgccatccattcgaattctcctaattttttcatgtaagaaaattatatcacaaaaaaactgcccagccattcaggcgtgggcagttgagatgattattcaccatcttgatttaatttattaattaatcggtcaatcttgtcaccatactgaactgatgtgtccagctcgaacttgatttccggtgttttataaatgcttaaccgatgaccaagttcgccgcggattagtccgctggctttttccaatccctttgcagttgtttcttcgtcctcttttttatcggacaaaatactgtaataaatggtcgcctgctggagatcacctgtgacttcgacaccagttaaagtgacgccctgaactcgaggatcgcggacccgctttaacagaatgtcgttaacttctttttgaatttcctgttctaatcggccaacccgataatgagccatcaaaacacctccaaattacttgacaggcacttgtttcatgacatatgcctcaatcacatcgccgactttgatatcgttataatctttgatagttaaacctaattcaaagccttgtttaacttcattgacgtcatctttgaagcgtttcaaactgtttaattcgccggtatagacaacgactccgtcacgaatcaaacgaactttactattcttctgaacgacaccgtcaaccaccataccaccagcaatcgttccgactttagaagccttgaagatgtcacgcacttcaacctcaccagtaacttgttcagtgtaggtcggagcaagcatccccttcattgctgattcaacttcatcaatggcgttgtaaataacttggtgaagacgaatgtcaacgtggtcgctgtcagcctgtgacttggcttgtggtgtcggtcgaacgttgaaaccaatgataatggcgttgctggcttcggccaaggcaacatcactttcattaatcgcaccaactccggaatgaatgatgttgaccttgacgccttcaacttcaatcttttgcagactgttagccaaagcctcaactgagccttgcacgtcagctttgattacgatgtcaacttccttcatttcgccttctttaagcgaatcaaacaagctgtccaaggtaacccgggtggtctttcgtcgttcctcaacttgagcttccttggcacgttcttcaccaacggcacgagcggtcttttcatcatcaaagacgacgtaacgatcgccggcttctggtacttcattcaaaccagtgattgatactgggcttgatggcgtcgctttcttaacatcgcggccacgttcgttcgtcatggtccgcactcggccgaatgtatgaccaacaacgattgggtcaccgacgtgtaaagtgccttgttgaaccagtaaagtggcaaccggccccttaccttgatccagacgagcttcaattaccgatccggcagcgggttgatccggatcagccttcaattccatcacttctgcttccaagatgatcatatcaagcaattcgtcaatattcttaccaaatttggctgaaatatcaacgaagatggtatcaccaccaagtttttcaggaaccagaccatactgcatcaattgatcggtaacatgttgtggattggcatccggtttatcgatcttgttgatagccacaatgattggcgtcttggcagctttggcatggttgatagcctcaatagtttgaggcattacgccatcgtcggcagcaaccaccaaaatcgtgatatcggtaatattggcaccacgagcacgcatttcagtaaaagcggcatgtccaggagtatccaagaaagtgatcaggttgtcaccgtgacgaacttgataagcaccgattgcttgagtaattccccctgcttcaccagcagtaatgtgtgaatgccgcaagtgatccagcaaagtggttttaccatggtcaacgtgtcccatgatcgtcacaactggtggtcgggataccaagtgatcggtattctccatttctttttcaaagatcttatccaaatcggacaaatcttcgtggactttttcttttgcttcaataccatagtcggctgccaaaatctcaatcgtatccttatcaagtgattggttttggttcaccatgacgccgagcataaatagcttcttaacaatttctgctggctcacgatgcaacaatttacccaattcctgggcgttcataccatcttgatattcaagcacctttggtaatggacgattctttcgttccggtgcaccatggtgttcaacttcacgcaatcgttgattcttttgcttacgttgtttcttgttgcgcttcttcttggctttgcgggagccgccacgattattattccggttcaagctgccgccaaaacgaccactgccggtattgtgatttgagaaattgttggaactacggtttgtattactgttattattcgaactggtatgattgcttgcagttgtattgctgccagttgaatgactgtttgtattacgggtcgacgtattggatgaattgtttgaagcttggtgattgcgtcgatcattattctggttggtccggtgattattggactggttcgaattgttggaatgattttgactattcgaatggttattattgttggaatgatttctttgagcagtattatttgtgttgcgagcaacacttgagtggccgttgttactacggttgctctctgcatttcggttagcctgctgtgtgtttcggcttaccggatgggacccgttgctgtcatggtgagcagccggtcgactttgtgcatgagcagtggcatgttcttttggctttgagcttgctgaatgaacattgttattgctgctcttatggcttgattgactgtttccagtcgattgattgccgcctttactaaacatcgcccgaatttgacgctcttggttagcgtcaacggttgacatgtgatttttgatatcgaagccctgtttattaccacggtcaacgatttgcttactggagacattcagttctttagctaattcgtaaattcgctttttccccatataatcactctcctttattgttatcggttaattcaaccaatttttttgccataccccgatcggaaatgccaataatggttcgtttcattccaattgcttcactaagcactgctttagtgtaactgttattcacgggtatatgatagtaatttgacttatcattaaacttcttttgagttgccttgccggtgtcttctgcgataaacaagaaaaaaatcttgccgctgcggatttgagacaaaagcatatcttgaccggagacaattttgcttgcccgccgtgccagacctaaaaaattcaaaattgcctgatcattgtccatcttcaaacaactcttttcgggcttgcttatggtcaacataggcaattagatcgtcataaaagttgtcatccaaagttgttgaaaagactttttcaaaagtgtgttccgctttagctttgcgggcaatctcaacgttaattgagatgtaggcaccacggccggatttctttccagtctcatcgattgaaacgtggccgtctgagtcacggacaattctgactaattcctttttcggcgccatttcaccagtaacgatatctttacgcattggaatttttcgttttttcaaaaaatcgcctcctaaaaattagtcttgagtgtcctcattcgactcatcgggattggtattaacatccgcaccgtctgtcggggcatcctcagttgaatcctctgtttgatcgccttggtcggaagcctcatcagcttctgtatcatcgctagcggcagcggctttgtcggcaagaatttccttggcttcagtttctgatttgatgtcaatcttgaagcccgttagcttagctgccaaccgagcattttgccccttcttaccaattgctaatgacaactggtagtcaggcacaatgaccgtgcaggcccgctcgttgtcatcatcaaagataacatcaatgacctctgcgggattcaaggagttggcgatgtaagatgcatcgtcttcatcccattcaacgatatccatgttttcgccgtggagttcgttaacaatggtttgaacccgctgacctcttgggccaacggcggttccaaccgggtcaatgtcggagttgtttgagcgaacggcaactttggcccggtcgccggcctctctggcaattgagacaatttccacagttccatcataaatctcgggaacttcttgttcaaataaacgtttgagcatccctgtagccgttcggctgacaaacacctgagggcccttggtcgcattctcaactttggtgacatagaccttgatacgatcctgtggacgatagacttcgttgggcatctggtcttttgaacccataacggcttcaactttccccagattaacgtaaacaaatcgggtgtcttgacgctcgacagttccggtcaccaattcatcttcatacttggaatattcatcaaaaacgttttcccgttcagcttcccgaacccgctgcatgattacctgcttagcagtttgagcagcaattcggccaaagttcttgggggtcacttcaaatttgatttcgtctcccagttcgtaacctttgttaatttcaagggcctcatcaagagatacctgaagctggtcatcaacaacatcgtcgaccaccgttttaacggcgtaaacgtgcatctcgccttttttgtcgtcgaatgacacttcaacgttttgggcctgaccgtagtttcgtttgtatgcagaaaccaacgcggcttccaaggcttcaatgacaacctcttttttgatgcccttttcttcttccagagcagacagcgctcctaaaagttctttactcattattgtgtctcctttaactaaaattgaattgcaagccgtgctttggcaattaagttccgcggtacttccaacgtatcctgcttaccccacttatcattttgaagcaccagtttgtcgtcatccaacgacttcaggatgccttcaaatgttttattgccgttaagattttgatagagggaaacgtgaatatactcgccaattgcctgtttgagttcggcgtcgtttctaagtggtcgctcagcacccggagacgaaacttccaggaaataggcctgggggatcgggtcgggatccattgcatccagcttttcgcttaattcatcgctgaccaagacgcagtcatcaatggtaatgccgccttttttatcaatataaacccgtaaataccagcttttgttctcttttacaaactcaacatcgaataagtaaaatgagtgtttttccagaattggttcaacaacttgtttgaccgtttcaacaacattgctcaaaaataggcctcctaaaaattatccattaaaaagagcgagcatctctgctcactcccttacaagttatttagtaaattaactataacatattcgatgattcattacaaggctggcgcgttttaacgccgatgtgcaaatcaattatgctcgccttacatcaaatcaaacaagttcaactgattttcatctggcaatcccgccagcacattgttctcagtcatgaagtcaatcaaagttttggaaactttaccgcgtttggctaagtcttctttggaaataaacggcttgtcctctctggcagcaacaatttgcttagccacgttcaatcccaatcctggaactgaattaaatggtgcaattaacgtatcaccatcgatcagccattgactggcatcagacttgtccaaatccaccatttgaaaatgatacccgcgttcgagcatctcattggccagttccaaaactgtcagcaggttcttctctttggtcgaagcttccattcccttatcattaatcatccgcatggcatttttgaccgcttctttacctctgcacatcgagacaatatcaaaatcatcggcacgaacggagaagtatgaagcatagtaaaccattgggaagtagactttgaaataggcaatccgaagggccatcaaaatgtaagcagccgcatgggcgcgggggaacatatacttaatcttcagacacgattgaatataccaatcaggtatcttggctttcttcatttcggcttgccagtcgtcaggaattccacgaccatgacgaacactttccataatctggaaagacaattcagagtccagtccccaattgattaagtcggtcatgatgttatcccggcacccaatcacgttggcaatggttgccgttccgttcttaatcagctcatcggcgttacccatccaaacatcggttccatgggacaaaccggaaatctgaagcaactcggaatagttacttggatgcgtctgttcaagcattccacggacaaatcgagttccaaattccgggactcccagtgttccagtcttagattgaatctgatcttcagtaacccccaagatttttgggctggagaaaatcgacatcacaccgggatcatccattggaatcgtttttggatcgatgcctgacaaatcttggagcatccggatcatcgttggatcatcatgacccaagatatcaattttcaaaatattatcatgaatcgagtggaaatcgaagtgggttgtttgccaagcggcatcctgatcgtcggctggatactggatcggcgtgaaatcatagatgtccatgtaatccgggacaacgatgattccagccggatgttggccagtggtccgtttgacgccggttgcgccctttgccagtcgatcttcctcggcttgtcggtagacttcacccttatcgcgttcgtaagccttaacgtacccatatgcggtcttatcggccacggtaccaatcgttccggcacgaaaaacgttcttttcgccaaacaaaactttggtgtagttatgggcaattggctgataatcaccagaaaagttcaaatcaatatcaggaaccttatttccggtgaagcctaagaaggtttcaaacggaatgttgtggccgtcaccaatcatcatggtgccgcacttgggacactttttgtgtggcaaatcatacccggagctgtattcacccttggtaaagaattcagtgtgttgacagttcggacaacgataatgtggcggcagtggattgacctcagtaattccggtgagggtcgcaaccaaactggaaccaaccgacccacgggaacctaccaagtatccgtccttgttacttttggcaaccagtcgttgggcaatcaagtaaatcaccgagaacccgtttccgatgatactctttaattctttatccaaacgatcagaaacaatcttaggcagtggatcaccataccaagcgtgggcggtgtccatcgtccgtgacttaatctcgtcttcggccccttccattcttggggtgtacaacttatccttcaatggatggacgtcctcaatttcatcagcaatttgattggtgttgtccacaacaatttcttcggccttttctgggcccaagaagttgaagtcactcaacatttcatcagttgtgaggaaatgaaggtcgggtaattcttgacggttcagaggattggcgccaccttgcgaattaatcaagatttttcgataaatgtaatcttgcggattgagatagtgaacgtccccggttgccacgaccggcttgtccagctcatcgccaagtttgaccatattggttaagatttgctcaagattctcatcatcggcgatcaaaccggattcaatcagtggcgcgtaagcacgtttgggctgaacttcaagataatcataaaagccagctttttggcgggcctcatccaatcccttttgcatcatggctgtaaagacctcacccgatgaacaggcagagccgacaatcaagccatcccggtacttctccagttgcgtccgggggacccgtggaacccggtagaagtacttgacgtttgacaaggaaacgattttaaacatgtttttgaggccggcctgggttttggccaataaaatggcgtgagacggccgagcatggcggtacgcatcgttatcagtcatgtgatcattaagctgatcgtgatagacaatgccgtatcgatcttcagcatcctttaaaaatagatagtttaagtggccggtggtttcagcatcatagattgctcgatggtggtgttccaaactgacatcaaatttcttagccaaggtattcagtcgataaccccgtaaattagggtacaaaaatctggccaaagtcaaagtatcgatgattgggttttgcatctcatgcatgccatgacgaacgtagccggtgttcatgaaccccatatcaaacgtcacgttatggccgacgacaatcgcatcgccacaaaattcccggaaaagtttgaagacttcttcctcagactttgagccgtgaaccatctcatcggtaattgacgtcagattcgtcgttcgttccgacaaatggaaacccgggtcaataaattcttcaaattgatcaatcacgttactgttctgcattttaacggctgaaagctcgataacgcggtcataaatggctgataagccggttgtttcagtatcaaaaacgacgtaagtcgcatcctttaacggaacgtgcttatcattgtaagtaatcggaacgccgtcatcgaccaggttaatttcaacaccatagagcatcttgatgtcatttttttggccggcatgaaaggcgtctggaaatccttggacacccgcatgatcggtgattgccagggctttttggccaaagtgcttggcctgcttggcaaagtcagcaatgttattagtggcatccatttggctcattgtggtgtgcaggtgtagttcaacccgtttcttatcatcatctgcagtatcttgacggctaaccgtcttaatggggttaatatcataggcattcaaagttagttcatgagagtagttatcctcttggacgctaccacgaaccttcacccaatcgccttcgttaacgccttcaaagagcgcttcttcacctttattggaaaatttctttacttgaatggatgatgtatagtcagtaatcttcagcatcaaaagctggcggccggaacgcaatgcccggatttctttatcgaaaatgtagccagagacaaccacagagcgttcctcttctacaatttcttccatcttcattacgggtaaatcatctttgattcgccgaccaatggttgacttgcccccaccgttaccactcttgggatgagcttgagcattctccttgatcgcttggttagccttcttgactaattccgcattggcagcatcgtttttcttcttgagggcttgaatgttttgctgagaagaactttcatcgacgatcgtgtgaattgtaaagtcaggaaagcctgcccgctgaaaggcatcttcaattggccccaaggcagtgttggtcataaagtccttgacgatgtcattttcagcgacaaactccacccgcgaatcgacaatggagggaaacttgtctgcacataattccttcattaacggtgaggtaaccccactatgtggaacgacccattgccagtattgccgaagcagttgttcagtaaaggtatcattttttgcagaaatattcagtgaaacatcagcgatttctttaaacgcagactgtagtctggcattaaaatcgttaaaaacctcaaatggcaggattcgtggaagtgaaatgtcaaattgccaccgctggctttgtttatgaacttccaggcgatcaattttagcatcctcaaaataaggcaattcatttgcctgtgtccattgaagctgttcaagcaacttttcaaataattgatttcgatccaaactcatcacaatacctcttctaaaaataacggtttaacaacaactggctggacacaaaacccaagttttggtccaaccagtttagaagtgacgaaaacatacgtctatattaattagttacgacatcattagtcaagattcttcaacatttttttgattgtgtcactcaattcggtgacgttaacctcaacggtttcgccagtttttcggattttgatttcaacaattccctcttcagcctttttcccgattgttactctcagtggaattcccatcaagtcagaatctgcaaatttaaccccggcccgttctttgcggtcatcgacaagaacctgtaattgatcagctgttaattgggcttcaatttgatgagctaaatccatttgaacggcttttttggcattaatagggatgacgtgaacatcaaatggggcaaccgctttgggccataccaacccattttcatcggcattttgttcagaaattgctgaaagtaggcggctgacaccaattccatacgatcccatgatgaccggcacagcgcgcccattttcatccaagacgttggctttgagactcttcgaatagcgcgtacccagcttgaagatatggccaatttcaatgccacgggtaaatttcagtgttcccttaccatcaggtgttttctcgccttctttgacaactacaaaatcgtccacgtcatcaatccggaaatcacgatcagaattggcattgacataatggtaaccattttcatcggcaccaacaacggcattcttcatgttggcaacccgttgatcagcgacgattcgaacatcctcaccaacgccaacgggccctaaagaaccaaagtctgcccccaaataggtcttggcttgtttgtcagtggccaactccagaaagtcagcccccagatagttctttaatttaacgtcattgacatcgtagtcaccgcggacaaggaccatcaccggcttctcatcggcaatgtacagcatcgatttgatggtttgcttatctgagacttttaggaaagcagccacctcggcaatggttttcgcgttgggcgtttcaaccttcttaaggtctgcttcaggttcagttgaaggctggtcgtcgacttttgatttggccatttccaagttggcaaaatagtcactttcatcggaataaacaattgtatcttcgccgacagcagccatagcagagaattctttggaatcagatccccccattgcaccgccatcaccgatgatcactttgtacttcaaaccaattcgatcaaaaatattgcgataagcctgctccattgcattgtacgttttatccagatcctcatcgttagtggcaaatgagtaagcatccttcataataaattcacggcttcgcagtaatccataccgcggacgattttcatcgcggtacttattttgaatttgataaagaaccagtggcagctgtttgtatgatttaatggaatcgcgaattaacgccgtaaacgtctcttcgtgagttggtcccaaaataaaatcggtttcatggcgatttttaaatttgaatagctctgggccatatgtatcatagcgccctgactctttccaaagatcagccggcaaaatgtcgggcatcagcatttcatgagctgatgttttttccatttcctggcgaatgatggtttcaattttgtttaaaacgcgataggccaatggcaaatatgcgtacatacctgcagaaatctggcggatatagccaccacgaactaacatttgatgacttaaagcttcggcgcctttgggggtttcttttaacgttgggatcagcatctgtgattgtttcatttataaggttctccttcaaaattaacttgtttaatgtaaaaagtatctctcaatatcattccaagtaaccagaatcatcaacagcatcaagaacgcgaagccgatcaatgtgataacagtttccgttgtttgagaaaccggctttcttctgatagcttccaaaatgtttaaaatcagtttaccaccgtccaaaccaggaattggaatgaggttgataattgccaggttgagtgagagaaatgcgaggaagttcaagactcctgaaagtcccatcttggctgcttgggaagttgtcgcaaaaattgccaccggcccacccaaatcgttgagactaaagtggccgctaaccatgctccacagggcgccaaacagctgcttggcgactgtccaagtcgtcgtgaagcctgaaaggatcttggctttaaagctggtatccattgtttgagtaatgccaatgaagcctgtcttttgaccgccagaagtctgggctttgggtttcatggttaagactttatcctgaccatcccgctggaccttcacagaaatttgcttatcagcttttgatcggatctgaacagtaagatcctgccaatcagtggtcttgtgtccgtcaacctcaacgattcgatcaccggatttgacaccggcagtccgggcgactgaatcagtgggcatgacattgactttattggtattggatgcaacaccaccttgaacaaaacctaaaattgtatataccaagatggcaagtaataagttattaaacacaccagcaacgtttgtcagcattcgattaggcaacgatgccgactgaaattgaacatctcgaggagcaatttgtaactcggtcccgtctttttcgataatagttgcgtcatgatcaaccggatacgacttaacttgggactcatcaccattttcatatcctttgacatacaaattatcgtcaagattggtatcggtgatggttaagggaatgccctggaaaagcgagtgtttattgctggtgttaattgatgttaccacaccactgtcattcaattgaagggtcaccggtgtccctggttttaattcgtcctcaccgtcatcggcctcaccggccatccgaacataaccacccagcggcaataatcttagggtaaaagttgtactattttttcgataataaaatacttttggccccatcccgacagaaaactcccggacaagaatgcccgagcgtttagcggtaatataatggccaaactcatgaaagatcacaagaataccaaagacgataatgaaaacaataattgtagttatcaagtgacactttcctcctaaaaactaaataacagctaacaaatgaagcattggtaaaacaaaaagtaagctatcaaagcggtccaagattccaccatgtccaggcagaatcttccccgagtctttgacgccataataacgcttcaatgcagattcaatgaggtcgccaaattgaccagctatagagagaataatcgtgaagatgaacatttgcaagagtgagtgtccggcaattgggtaaaatgcgataaatgcggtacataaaatggtggctgcaagtgaaccgccgattgaaccctcccaagttttattggggctaattcttggtgccaacttgtgtttgccaaacattctaccaaaaatgtacgcgccactgtcagttacccaaacgataaacaaagcatatagcaataccgtcagtccaactccccgcgcggcaacgaagtagtgaaatcccataccgatatacagcatgcccaggacaattactccggcatcatcaaatgagaacaggtttcgactcagaaccgtttggagaagcagcatcaaaacaaacaaaaagaagacaaagttttgactgatgtgtccgggtaaaaagctcgtccatgcatctggcagaatgagtgaacagactcccaaataagcaataattgattcaggtgaaatcaataatttcttcttcatcaccaatatttcagagatggctacaatcccaagtgccaaagcggcaatatcaacccagattccacccattacgatgattggaataaagattaataaagctactacggctgttatcacacgttgtctcaatttgtttctcctctatttactagttttaattccgccaaaccgacggtcacgctgctgatattccatgatcatttgttcaaaaaccgttcgatcaaaatcaggccacaaaacatcagtaaaaacaagttcactgtaagcaatctgccacagcaagaaattggatatgcgctcttctccactggtgcggatcagcagatcgggatcggctaaatcgccgagaaatccggtcattaaatttgcatcgatggtttgatccgtgatctgctctggatccagttgaccgctggcaacctgacgaccaatttgctggactgccattctgatatccaaacggctgccataattcaaggcaaagttcagaatcatcccagtacagtcagcggtgtctttaatagcgtcattaaccgccttttgagtttgaacgggcaattgatccttgatacccatcacacgaacttgaacattatttttaaccaagtctggcacgaaatcgttgaagaacttaaccggcaagcccattaaataaatgacctcgtcatggggccgtttccaattttcggtcgaaaacgcgtataacgtcagaaccttaacaccaagatcactagcgactttggtaatcgttttaacggtttccatcccgcgtttatgaccagcaatccttggtaaatggcgtttctgtgcccatcgaccgttaccgtccataatgatggcaacgtgtgccggaatgttgtctgttttgagttgcggggttgcttgttgattgtcttgtgtgttcttaaacattttacgctccttaaaaactgaatgttggcttggctgtcagattcaaaaacagcatgggatcctcgcgacatatcgttaaacaccaaatggctggaacaaaaccaaagttttttcccagccataaaatgctattcgtattagtcggattcgccgtctggacgttcaaccattcgccattcaccgcggtttgcctcagccaatgtgttgaaatacttcaacagcttattggcatcttccggactcttttggcccagcaggtttaagcctttgccggttgtatagggttctgaaaggtccgtgatttcatggtcgttttcaatagttgctgtagaaaaggcaattacccagtcgttttcaaccagttgcgaaacgatgaagaataagttaaagtcgtcgtttacatatgcaggcattgcatataaaccatcttgaaccggctgcaagtggccgccgttataatccaagacgcccaaattgtcctcagtaacaggcgtattcagtttaaagagcatcttgccaaattcatcggttccagggacaaccgcaatttcatcgttatctgaattattattgttattattatgattatctgccatcgtattgacctctttctagccgttcatgacttcttgttctttgtcggcgacaattccgtcgacacctttaattgcatcatcagtcaatttctgaacttgatcttcatagcgatgcagttcgtcgtcagtgatatcttcactcttattgctacgcttgagtgtgtccattgcctctcgacggacatttctgatggcaaccttactcttttcaccggttgccttgacctgcttcgcaatttccttacgccgatcttcagttaatgcgggaacagccaatcgaattgccgttccatcattagccggactgatgcccaagtctgcttcataaatgcctttttcgatgccttccaaggcacttttatcgtaaggggtaatcaaaatcacccgtgcttctggaatggtaatcgaagcgatttggtttaagggcgttggtgcaccatagtaatccaccatgaccccactcaacaagctggcgttggcatgaccggcacggatactgcccatatcatgttccaatacctcacgggtattcttcattttttctttcgcttcagttaatactgattgtgcatctgccataaattatttctccttcacagttgttccgatattatcaccagtcacgaccttacggatattgccgggcttgttcaaattgaagaccaccaatggaatgtgattatccatcgacagagaactagccgtagagtccatcactttaaggcctttttccaaaatatccatatatgaaagggtatcaaatttaactgcatctttgtgagttcggggatcggatgaataaatgccatccacaccgtttttagccatcaagatggcgtcagcaccaatttcggcagctcgcaacgctgcagtggtatccgttgaaaaataaggattaccggtgccggcagcaaaaatcacgacccggcccttctccagatggcgaacagccttccgacgaatataaggctcggcaatctgccgcatttcaattgaagtttgaaccctggtcggaactcccaaatgttcaaggttgtcttggagggccagcccgttcattgttgttccaagcatgccaatatagtctgcttgagcacgttccatacccatctcggcaccggcttcaccacgccacatattgccgccgccaacaacgattccgatctggacacccaggttaaagatatcttttatttcttgggcgacgtttttgataacaggtggattaataccaaagccgcggtctccggccaatgcttctccacttaattttaaaataattcggttgtattttacttcagacatccaagtgcctcccatagttaatcgttactaccaattttagcatattaacgttgcaatcaacaagaaaacagggatattcaagaattcttatcaaatattctcagccagttcacagagatgtttcagaaaacagggttgagttattcatgatggtaaataaaaagagttaggaaaagcggaatgctctgtcctaacccctattatttggttacatcagtatctttggaaaaatgatttataaactaaattcgctcagcttacttcaattgatcgcgaacttcatcttcgaagctttgggtcttcttttcgatgccttcaccgacttcgtaacgaacgaatttaacaattgaaccgcccttggaagcaacgtatttggaaaccgtgacgtctgggtctttgacgaagtcttgatcttccaggcaaatttcggccaagaatttgtggagacggccttcaaccattttttcaacgatcttttcaggcttgccttcatttaaagcttcttgagtcaaaacttccttctcatgagctaaacggtcagcaggaacttctgcttgattcaaatattccggattagttgcagcaacatgcatggcaacatccttggcagtttcttcgtcagcgccttttaattgaaccaaagcaccaatcagtccaccattgtgcaggtatgaaccaaagacttcgtcatcatttttttcgacaacttcaaaacgacgtaaagtaactttttcaccagtcacttgagtcgtttcaattaaatcgtccttaacagttcctttgtcggtctgcaatgccattgctgcatcaacgtctgcaggcttgttggcaacgattgcgtcactaacacgtttaactaattctttgaatggatcacttgacgcaacaaagtcggtttcggagttgatttcaacgattgcagcggtattacccttaactgcgatggttgccaaaccattggcggcaacgcgatcactcttcttctcagctttagcaactcctttttcgcgcaaaacttcaattgctttgtcgaaatcgccttcagttgcaaccaaggccttcttagcgtccatcataccgacaccggtcttcttacgtaaatccattacttgagatgctgaaatttttgccatcttagtggcctccctttaattgtgactaataattgtgactaaaaactgactccacaccaaggccaaattggtccaaagcggtagagtcagcccgagtgctaatatttatttgttagaatcgttgctgccttctacggcgtctgcaatgtcttcaattgaatcttcttttttgtctgctttggcgccatctttaccttcaaaggtcttttcgttaacgtcatcttcgccttggcgaccttcaatgattgcgtcagccatctttgaagtgatcaaacgaacggcacgaatagcatcatcgtttgatgggataacaacgtcgatttgatctgggtcagtgttggtatcaaccattgccacgatcggaatgttcaatttcattgcttcgtgaacagcaatttgctctttacgaggatcaacgataaacataacgtctgggatcttaggcatgtcttcaataccgcccaagaatcgttccaatttctgttcctgcttgattaaaagagaaacttccttcttaggaagaatgtcaaaagtaccgtcagttgacatcttcttcaagtccttcaaacgcttaacacgtgattgaatggtttcccagttggttaaagtaccaccaagccaacgattgttgacgtagtattgaccggcacgggttgcttcttcagcaattgaatcctgagcctgcttcttagtaccaacaaacaagacaacggcgcccttggcagcttcgtccttcatgaagttgtaagcaacatcgattaacttaacagtcttctgtaagtcaatgatgtaaataccattacgttcagtaaagatatagtccttcatctttggattccaacgacgagtttggtgaccgaaatgtactccggcttccagtaattgtttcatagaaataacagccatgatgtagcctccatattgtttttttcctccccaacgatcatttgaattaagaaccatccctggcaactctcaacccattacgtcaggtgtgtatttaaaacacctttaaaagtatataagaaaagccgcggaagcgcaagcacaaatacccggaacagattaattttttgtcaaaattgttaaatttcgatgaatcatgttagaatgatatttcgtggcgaggaggaatttatacatgattaaagccatcgttttcgatatcgacgatactttgtatgatacaaagcccgcatttgtacaggctttcgaagaaacatttaatctaaatttaccagaagaacagatgaatcagatctttgccaactacaatgagcaggaacagttggcaattgcagaatccaactcagactccgatttgaaattatctgacgaagaaatcaactatcattcattacaccacacgtttaaaaagtatgatttgcccggactgacacaagaatctgcgaaagccttttcggaggcctttgaaacggccagcagctccattcatctatttgatggattgaccactgtctttaataccctgaccaccaagttcaagttaggcatcatcaccaacggaagcaatgatgttcaacttgccaaaatcatgaagctcaaacttcatcattggtttagccgcgaacaaatcattacctcagaagatgcgaaggctaaaaaaccggacccgcttatttttaccttgatgaaccgaaaattcaatttacggggcaatgagatgatgtacatcggcagctcctattttgaagacattgtgcccgcaaaaaaagccggctgggaaaccgtgtggtataacagccatcaaagtccaatcgcagatcctcaaatcattcccgaccagacagtcaaaacaccggaagaattaaaagacttactcatggatttggctgctcaaatagactaacctaatttaaaataaaaaggtttcaatcagatatcctctgactgaaaccttttttgtatatcaagccggttaaattaaagttcaaccaacttgtctgatttaccagtattaattaatgatttgtttgcgtccatggcgaagtagaccatgttacgagcggcccgttttgtgtagaaggcaatatgtggacttaccaaaacgttttcacgtttcatcaagttcttgagtcgttcgtcagggatcttgtcaaagctgccaaagtcggtattgaaaataccaacttcgttttcataagtatcaagggcagcaccgcccattttacctgaatcaaggccgcgaattaaagcatcagtgtcaacaagggcaccacgagctgggttaaggatgaagacaccgtctttcatttgagcgattgtcttatcgttaatcatatgttcgttttccttggttgcaggcgcatgcaatgaaagaacatctgattgagcatagagttcttcaggagtatcaacataaaccccttctttttcaagctctggattatgataaatatcataagcaattactttggcaccaaagcctttgtaaatgcgcattgcagcccggccaatccgaccagttgcaaagacaccaacagtcatttggttcaattcgtcagcaatatctggtgcccaacgaaggtcaccatttgcttgtttgcggtcgaatgtgttggtccgacgaagtaatctcattaactgagttacagtaaattcggcaattgcttctggagaatatgcaggaacattggtaacttgaataccgttacgcttggcagcgtcggcatcaatattatcaacacctacgttacgaagtgaaaggtacttgataccaaagctgcccagcttatctaatacagatgcagtgtaaggcttttgttggtatgtaaccacaccatcagcaccttttgcttggtcaacagttgagtcgtcaagtaattcaccggttgaagcaacttcaacgtcgggattttcttcactccacttgtctaaataaggtttctcatcgtcacgaatgccatatgcaataattttcacgaatattacctcctaacagaatacttaaagtataacactttttgataataattttcactacttttcgtagtttgttcaataattcactctaattttatccccgcttgagctaaatgggcaattttttgagcccgactcaattgtttaaaggcgtattcagcgctcaaggcagcgtgtttggtgtcaaattgttgcttgaacaaaattttgattggtcggtgagagcgggtgtatttggcacccaagcctttcacatgctgttgaaatcttctttcaacattcgtggaaaaaccggtgtacaaagtgtcatcggcacataaaagcacgtacatataatacttatctgtttgttccataaagcatcttctttacttcatcagtatagtcatcgccgtcataagtaataatatcgcggttgactttgagaccgtttggcttgccgtctttaatcgcctcaaccaggaccatgttggcatcctctttgattcggggtctgacaaattgaagccgttttggctccagtcggtgacttcgtaacgccacgatcaaatccgtcagccgatcgggccggtacaccatgaaaagtttggcgttcattttcaacagtccggctgctgagctgacaatttcatttaaattagtggtgatttcatgccgcgcgatggccaagtatcgattcggattcttttcgctggtcttgtagttgacgaaatacggcggattgcaggcaacaacgtcaacagaatcttttggaatatattggtcggcatttttgaggtcgtcgttgaccactgatatctgctgacccaagtcattgagttcaacgctccgatgtgccatatccgccagccttgtctgaatctcgatcatggtgatgtgagcagccgttttttcacttaaaaacagtccgactgccccattgccggcgcacatgtcgacaatttgtttggttctgtgttgcgtggtccgaacaaagtcggccagcaaaaccgcgtccaatgaaaacgaaaaaacgtctttgctttgaataatttggatgcctttgctgtataattggtcaattcgttcgtcttcatgtaagtttacttgcatatcgttatgttccttcacaaattagtttgccaaacgcttctattttaagttaatataattctatcagatatgaaagaaggaaatgaattgttttattcattcatgagagtccttgtccgaatcctggtgtttattatcaatggcaatgcccgttatgagcacaaggagcgactgccaaaaggcaactatatcctggttggcccccatcgcacctggtttgatcccatttactttgcactggcgggcagtccgaaaaagtttagtttcatggcgaaaaaagaactattcaaaaatccaattttgcgttggattttggttcatgccaatgctttttcggttgaccgtgataaccccggtccttctgccatcaagaaaccagtccgaattctcagaaaatcagatttgtctttgatcttattcccatcaggcacccggcattccagccaattaaaaagcggcgccgcctttattgcccagctgtcaggtgtgccgctggtcccggccgtttatcaaggaccactgacattcaaacagctttttactcgaaaacgggtcacgattgcctttggagaacccattacaattgaccgtaaacaaaaattaacggatgattttcaaaaacaaattgaaacggaaatgcaaagcgcgttcgacgccttggattatgccgttaatccggattttaaatacgttgatgtatcaaaaaaagaagagtaagtgaaatgacaaaaagccctcaccaagttggtggggactttttgtcattgaaacattctaatttttaccagtttggttttgcatcgaatgcatcatttgatttaatttcttttgggaaggtttttgacccatttgtatcatcagttggcgcaattgatcttcgctgaatggtgggttttctttgaggtacttttccatatacttccgagcaccgtaaaagccaccaaccaagcccaagatcaaggctaacacaacgattaatatccaaatccaagttgccaagacaaggcctcctttatcatatcactaagtaattttacacaattatgccatagaattaaagggctaatcaacaaaatcccgattcttaggggaaaactgccccctaatcgtcccgaagacctttgtgacgttggacttccctgacttttccgggcgtcacttccttgccattcttatcataaactttcatcatttcaatctgttttttgaagttttcacggaagtgagcaacgtattttttacgcaaatcagcctgttccaacttttcaacttcagataagccctcattttttgctttgtgggccagttcattaattcttgggatgagttctttgaaaacatcgtcaccgatttttgattgcaattcttttttctcttgttcgttcattaaaattcctccatatcgactataataacacaattattgatagttacgcgaacgtgtgttttgaaatgtgacccaggttatgatatgatttaggtattaaacaaagacttatgaggtgtctaaaatgtcaaaaacgaccaatgatccccaaagtaaacaataccagatccttcacttcatctgggaacgggttaatgagcagggctatccaccaacggtcagagaaattggtgaagccgttcatctatcctcaacctccacggtacatggccatattgctcgacttgagcggaaaggctatatcgtgaaagatccagccaaaccccgcgcgctggaagtcaccagtagtggcttggatgtcctgggtatgcagccgcagcaaaaacagattccggttttaggaactgtgactgccggtgaaccgatcttagctgttcaggaagccaccgactacttcccgctcccgcctgctctggcacacagtgatcaaccattatttatgctgcaaattcggggcgaaagtatgattaacgccggcattctcgatggggactatgtggttgtccgcaaacaggaaagcgccgataacggtgacattgtcattgcgatgaccgatgaaaatgaagcaacctgcaaacggttcttcaaggaaagcgatcattaccgactacagccagaaaacgataccatggcgcccattattttgaccaaggtcagcattttgggaaaagtggtcagtttgtaccgcagcgatatttcataattatttctacctaaggactgttctgctaacagtccctttcttttaccctgagttctggtccaggacttttcggcaatgcccaacgagcccttctaccatcaatattatgcctgttgatctcgataaaccagctggtcggcctgtctgccaagcaacacgaatcgactgtcatcatcggcagcatcaaatgtaacatctccaccggcgtttggcaatccatttgcatacatcgcttcatactcaggaacagacagcctcgttcggttggcaatcacttgttcaacctggccggcaaggctctgcggttggatttcaggggcaattgtaccactgtaaaattccccttgagctcccgatccataactaaacaaaccaattcgatcacctggctgaagcgttttggagttggccagtagtgataacaagcttaagtagagtgacccggtatagagattaccgacgagggcattatactttttagaatgatcgaattctttgagcagctgttgtgagtgagcaccatcatcgataaccgtccgaagcgcttttaggcccatcttggtgaatggcagatgaaaagccatcgcggaaaaatcactcagcgtccgttgatatttcgcagagtaatctttaaatgtttggttgaagaaatcgatataaatatccgttgagtaatgcccgtcgacaattgcatcacgacggtaaaacggccgccaaaaatccataatattttctgagtaaaacgcactttgattgtccaaagctaaaatttttggatcctgactcatcagcatggcaattgccccgccgccttgggtgacctcaccagctgttccaatcccatatcgggcaatgtctgctgccaagaccaacactttactttcaggatgcattgcaatatgatcgaaagccatctgaacgccggccgtaccaccataacaggcttgcttaatttcaaacgatctggcggagttggatattccaagcaacgactgaacatagatggccgctgacttggagttgtcaacaccggtttcagttccaaagatcaccatatcaattgcttgtttatcgtcatcgcttaaaatcttggcggcagcattggcagccatcgtgaccacgtcttgtgttggcgggattaccgcctggttcttctgtccaatcccaatcaaatatttattgggatcttccccgcgggcatttgccaaatctgccatatccaaatagtaatcagaagtaaagaaacccattttgtcgattccaattgtcataatactctcctttaagaaagaatgagaccgaatattttaggtgcaatatccagtctcattatgtatgccgctgattgttaatgattatttattcgaattgttatctgtaaaactatattgtgccctttgacctccaacaagttttggtcttgaggatagagttacgaccccagcgtgaccgacttgacgatgggctgttctaacagggatttgaacaaacttcacatgcatgccaatatctgtgccaccaatatctattccaccgaaagcagaaatgtgttcaacttctaccgggcgttcaaatctttcatatgctgctacctgggtaccacctcctgcatgaatggcaggaacaaccgagactatttcaagattatttcgctcagcaacactttcttcgactaataatgctctattgatatgttcacacccttggactgccaagtgaatatgtcgcatcctcagaaatggatacacagtatcgatgacagctcggccaatatctagtctagaatttgtacctttccaatcgccaacaatttcacttgtgctgcatccaacgacgaaaattccgttccgcggaaactgaacattttcaaaataatcaattaagacgttttttaaatcagtttttacttgttccaaattcataatggtcacactttctagaattttattccacaacgtaaaagattcaatgtaatgttttctaacatgcataaacgctttattatcagcgcttacatccatttacaatgattatctgactaatatatagataagaaaggttgctttttctaaataaaaggagataatagttattaatgatagacaacaaattatgaatttttatttgtatttgatacaattacaatgacataaaagtttatgacttagtcgttctaccataatctaaagaaggagggaaaagctaatgtttaatagttttgatttaaacatggatttttgtaccagcttatttttcagaaacagaaatcgtagtaatggccatattcttggtctagatgggagaaaaatgctcgaacagctgggcatcgatccagtaactaacttttcccccaagaaccaagatatgggaaatcaattcgtaacttggcaaaagaataacaatagtttacctacacttaaaagccgaaaagattgttttgctgaattcgcgaaaaacgttaaccgtcttcgtgatcgaggtttgggaacccaacgtaaaatccgattcattgataaggttgattattcgttggacgtctcggtagtacgatcattaacaccatcggacgcagttaatctttataaacgccaaatgggctttctatcaatgtattcgagcgcccctaatcctttccaagcaatacgagatctatttagtggtgcatcagtttatagtcgtccagaaaacggtgggtacacccctgcaaaggattttgctggaacatacgtaaactttctcctagattattatttttcaatgtacattccgaattccagggaatgggatatttatctcatgcaacaaagaatggcattaaacgaaattgaaaatgatgtttttaccatgctgaatggacaatctgtcaacaactccttggacgaaaatagtgagatacaagtcaccgcattttctacggttggtttggaattaattgctgatattctcagaccagttcgaatcgattcaccacagattgaatcattcgaacctgcatttactgatgatatttggatgaattacttcccatacacttgggcacttgtcaatccatctgcagcatacaaaattatcaatcattaacgcttatacaatgaaaagggctggacaaatcaatttgtccagcccttttctgatgcccatcatccggaccaataatataattgatcgatggagataatttcccaatccgcacagtagaacttagttgttaactctttacttcagttcctgtaagcgccttatcaaccaaattaataattgtactgatcgaatacagttttaaaatgctaccaacctgtggagcattagtattccctgtaaaggttacgtttaatgggaaatacagttctctccctttaattccagttgcatttcccaccgatcggataatcgtgtcaaagtcgatatcacccttttcactggcatctaacaattctctcctaaattgcatcaaaattagtcgaacaaccaccggcgagaaatcatcaaattgtgagtaatcaaatgtctcactatccacatttgcaaagaagtatactttttccataatgtcggtaagtttataaacctcacgttgataaaccttagttacatgcttgatgaattcacgcaagtttggcaaattaacatcctggagcttcttagcaatctctgattcgccttctttaatcagatccattatccgatccgttaaatctgcaacatcagcatttttgatgtattgagagttcatccagtctaatttgtgttgatcaaagaatgcaggagatttagacatccggtcgggatcataagccttaattaattcgtccttggaataaagttctttttcaccaactggagaccatccaaggaatgcgataaagttaaaaatcgcttcactcaagtaaccttgattcttatactgactaataaactgtaacgtttctttgtcacgtttacttaactttttgccagtttttggattgtaaattagagtgatatggccaaatctaggtggagtaataccaagcgcctcatacactgcaatttgctttggagtgttcgcaatatgatcatcgccacgaagcacgtgtgtaatatccatcaaataatcatcaataacaaccgcgaagttatatgttggcattccattactcttttcaataatgaaatccccacccatattgtcagaattaaattgaacgttaccttttacaatgtcatcccaagcatagatatgattacttggcaaatgaagacgcacatcaggctttaatccctgcttttcagctgccttttgatcttcttcgcttcttccataccagcgcccgtcataatgaggggcttcaccgttttttcgttgttcgtcacgcataaccttgagttcgtcttcagtagtgtaatctttgtaggcaaaccccttgtcgagcaattgttggatatacttgtgatacaatgacactctttgggtttggtggtaaggtgcgtacttaggattaggcttatcaggtccttcatcccagtcaattccaagccagtgtaagttttctatctgactgtcttcaccatgaggaacatttctctttgtatcggtatcctcaattcttaataccatcgttcctccaaaatgttttgcaaacaaatagttaaacaatgctgattgtgcattacctatatgcaggaatcctgttggacttggtgcataccttactctaaccttcttatcgtccattttctgacacttctcccatctgattatttactttatttattgctgaccgttgttgcgtctgctgctgaaggaatattgtattccaattcgttgtttccatgttccttgttcaaattatgaatggccatctttagatcctccatgaagtcatccaaaattgtcatagtcattgatggtcttacaacaatccgactaatagttgtatcttcacgattctttggaagtggatatgcaggaacttgccatccatactttgcaagttcaccttccaagtcatacaatgtccaatccacttttgcatcatcagcaagcttccagcagttaatcggcaactgacttccgtcgttcaggatttcaaaaataccaaatttctttaattcttctgtaatccgcaatgaaaccttacgaacattgttcataatcgcttcatagcccttgtaaccaaatcgaacaaagttatagtattggccaacaatgtgggcaccactatgagaaaagttaatagcaattgaatcaacacttgaaccaagatatggtacagagaatctcatttcttttggcagtagatcctcagaattgtttctccaaacgatccaaccaataccaggataaaccattccgtatttatgaccggatacattgatagatacaacgttcttcaagcggaaatcccaaggcttgaatccatctacaaatggtgcaaacagtccaccaaacgcactatcaacgtgaattcggataggaagcacagcggtcttgttgtattcagacactaatcgatccaatttttgaatgtcatcaaccgcacccgtataagtgattccctgaattccaacaataccaatagtattttcgtcaacgtaatccataacatgatccatgtccatagacatatggttctgatcaattggaacctgtcgaagttcgacattccagtaagtgcagaatttttcccaaacaacttgataacctgacataataactagatttggaagatgatgatgaagatctttcgtatcaaagccggccttttccgcacgatgtttccagctcaacagcagtgacagtcccccaagcatgcaaccttctgaagatcccacagtcgatgttccaatgaaatctttgtacatcttcttgcccttagggatcccccataagtgagccaacatgcttacacagtaattttccattgcagctgtcttaggatattcagacttatcaattgcattcgtattaagagcatctgtcataagcttatcggcttctggctccatctgtgttgtacagaacgttgccaggttttgattagctttagcttcattcagccgataatgctggacaagttgggcagcaatgctagctggcattggatgctctggcaactcttcagttggcaatgatttaccagcttcaacacttcctaagaagttctgttcaagaccaatttcatcaatcatctgttcatcatttttttcactcatcgtgttatagctagattacttattgggtaaggtagcttcctccttattttttaaaaattttgagccgttcacaagtacctactttttagcagtttctccatgcgcctgtggggtaataacaacagttggtttttctgtttcttctgcaggaagtcccaactcgtttgcccaacgtttgtggtaacgatacaaaataaacggaatgaagaatacaacagcaaatccagttaatagcaatgtaagatatgttctttgcgaagatgcgatcatatcctttggcgggaagaatgttacaaagaatccaaacgcagaaagtatgaatcctaatccaccatatactaatctcataaccttactcttggatgcaacgtaaggtcggttcaaatcgctgtgcttaatttgaagtaccaagtaactaatgaatagcaacatgtacattagtgtataaagtgcaacggtcaagctcattgcggtttggaaggaaaggttagctttacttccacctgctccaaatgttaataatgcacccatgattgatacgataattccttgtaaaatcatgacatttgtttcaacaccatatttatttgctttagaaaatcgtggtggtaagaatcctgacttagctgcttcaaacattccggcattcgggcccacgacccaactactaatttcaccaagaacgccgacagcaagcaagaatccactaagcttttctacgataacaacactaattccaaacttttgtaccagtgcgccatatgcgtatacaattccagtacttaattgaatatccttattaggaattgttccagcgatagccatacttccgacaatatctgaaacgatagccgcgatggctaaagccaacataaccttaggatagacacgtggatgatccaaatccttaacatgcggagcggatccttcagcaccggcaaatgctaacataaatggaacaaacccaacaagtacatccccactccaactgcttggaagaatactatggaaattgatattgatcagcattgggttgccttgtgcaaggtagataatgaagattgcaagtaagaaaaataccggaataataacacctaatgtgaaacaccattgcgcgatcttaccagttaatttcgttcctctttgttggaccaaaatcaatccccataagataaccatcattaatccaaactttacgaatggattatcattcatgattggtaatccgacacttattgaaaggcatccaataataaagtacatcatcgtgttcattccaacggtaatgtgaacccattgatagaacaatgccgcccatccagttttttcacccaacatatttcttgcccaggtaaatattccacctcggctccagccgtcaatggaagccatttctccagctgccttcgtaactggaataaaccataagatcccagccaagaagagaaagaacaatgctgtggggccttgcttagcaaatgccgcaaagccataaactgtcatcaccatggaagttgtcattgagaacaactgaaacccggtgatctggttggcgtttttaatgctttcagcatgagattcaacgtcgtctctttccaaaccaaatacatctccttcaaacgtggtaccgctttcaaatgctaacagaccacgtttttatttattaactaagccatctctcttagttacgtattgagcataaatcagaaatattatgttgcaaatatacaaaagctaccgtttgtatatcttctatacacctgaccccatatgtataggatgtaaaattctgcgactaaaaagccaagcgataaagtttcatatcgcttggctttttgggaaacgtgatcataattaaaaaaatataattgcaattgcctatatggtagacgtggaatggacaaagtgtccagtttgatcaatacgatctgtatcaactccaagaagcatcttaagatgaggcatatcaatattcaataaatcgttgactaacaattctggattctctctcaacccatctgtaaaccagttgataatgataccctgtagtccatactcaaaaagcttccaaggttgttcttgcattcgattacgtgaaacatccttttggagagatttcagaaccccatggagcatcaaatcaattgattgaagaacgaagtccgtaaaaagtgagtatgcttgagaatccacgatatgctgcataaactctttatgataatcaatatatctgaatatcctcaagtagcattcttgccaatttgagtaatccatatctgacgcaattttgtcagcaaactcagacagtgtgtactgaaggcagtcaaatttatcttgaaaatgataatagaaagtttgtctattaaaagaagtatttgaaacaattaattttacagatacatcatcgaaagatgtcttagttacaagttcttctaaggatgtgcttaattcatgcttggctattgagtccatctaaatccctcttttcaattcttaacgctaataatatgattactcagcaacatcatcataacacttcaataaagattttaaagcggtttacgacattctaattaagcgttttcatttcagcgaatttgctcatttttcccatatttctataactttctagtgaaccgtatgtttcatcataaaatgtccgttatactggcatacgacacatccataactttgtctattagtgattaatcgagcatagaaaaactttgtttattttactaaatcattaaaaattctaattatattagcgttttttaattctatgtgtgacaaaataaggcctctttacaatcagtaaatagccgactgtcaatagttgataatgacagtcggctacttgagagagaagttatattatgaaattgggttagctggattcgaaccaacgcatgacgggatcaaaacccgttgccttaccacttggctataacccaatgttgaaaaatgacccgtacgggattcgaacccatgatactgccgtgaaagggcaatgtcttaaccacttgaccaacgggtcatgtcattccttacaaaacatattatgcaacatctcaacaaatggtgcactaaacaaaaatcgcattttgtatagttacaagcaataatttaacttatcgacccaaccacaaaccgcaaaccacggccaaaacacctaaggcaaccgtcccaagccaataccaaccggcaaccaaatactgacgattgcgaaccaagacaaacgtatcgacggaaaacgttgaaaaagtggtgaagccaccgcaaaccccagtcagcaaaaatagcgccccagttcccggtagctgactcccagtcaaatatccggccagaaacgagccaatcacattaattaaaattgtcgcgtagggaatcgtcggtgataccaatttgcccagaacggttatcccataacggcaagcagctcccaatccggcgccgaatcctacccagatcatcgttgtcatcgctgacgcctcccaactgcagtagccgctaagtagccaaggaggacacagagcatgccacccatgagattgaccagtaagaagatcagtgagcccaagggattgctggaaatcccctgcacaaattggacagtaaaagttgaaaaagtggtgaaagctccaacgaatccagtaccaagcccaagaatctgccactccggtaaatcaaaccgcaaatctaggccatagattgtaaacgtcagtaaaaagcaccccaccaaatttacgacgctggttccaaacaacccattggcactatggatccagtttccaatttcatatcgggcaatgccgcccagcgcgccaccgcagaataccgcactaacctgccctaatcgataccagccattatttttcatcatgtcctccagttaaaaacctcatttcagtatatcgaacatcatgaaaattttcatgaataatcgaattttattgaaaatttctccaagttcaaattcttgtaagcccctccaatccttggtaacatcaattaaacaggataatttagtcgttcagattatgatttgaaaggggatcgccaatatgaaatacgccgttaccggggccacgggaaaatttggtcaaactgtcattaaagtgttagctgaaaacgttgataaccgagacatcatcgcactggcacggaacactgagaaggctgagaaactgttgccgggtattgaagctcgaccagggtcctatgattcgcaggaggtgctggaaaagtcactggccggtgtcgataagctgctgttaatttcctcaattccgggtcaggcagtcagccgtatccaacaacaccaaaacgtgattaacgccgctaaaaaagccggtgtccggttcatcgcctacaccagcttcccacacgcagacactgccaaatcaccacttgccgttgaccacaagaatactgaacaggctatccgtcaatcgggaattggttactcattcttacgaaacaactggtatctggaaaatgagcgcctgcagattcccgcagccattaacaaccgacccttcgtctattctgccggaaacggccgggttggctgggcactggaacgggagtacgccgaagcagctgccaaagttttaatgaccgatgagccgaaaacagtgtatgaattttccggaccgcaacacgactatgccgatttggcccgcgccttacagttagtcaccgataacgactttgaagtgatgtcggtttccgatgacgaataccgtaagcgccttgtggccacaggatacagtccggcagctgccgcttcaatcgttggcatgcagcgcttgattcgaaatggtgacctggaagaaacctccaacgacctccctgaagctttgggacatccgctaccgacttttgaggaatcacttaaggaagtcattgataaattgaagaagtaagcaaaatcctctcgcaatgttctttcacgagaggattttttctatctcaatgacggttgctttccctgcaaaccacaagtatcataatcgataaagaaacaattcgggaggcagtcatggcatatatcgacgtcaaacacgtatccaaaatttacggcagcggcgagcaggaagtccgcgccaacgacgacattaattttgaaattaaaaagggcgaactcacaattattgtcggcgcctcgggagcggggaaatccacgctgctcaacattttaggcggaatggatacgcccactaaaggagacataatcgtcaacgatcgcaatatcgcgacctattcgccaaaacagctaacgacctatcgacggctgtcagtcggatttgtcttccagttctacaatctgatccccaacctcaccgctttggaaaacgtcgagttggcatcccaaatttcaccagactcactggacgtacccgaggtcatgaaagacgttggcctggccaaacgaaccaacaatttcccagcccaactatccggcggcgagcagcagcgagtcgccattgcccgggcgatcgccaagaaccccgagctgctcctctgtgacgagccaactggggcactggattataaaaccggtaaaagcatcctcaagttactccaagatttcagccacaaaacggacaagaacgtgatcatcgttacccacaatggcatgattaaaccaatggctgaccacatcatcgaaattggtgacggtcaggttaagaatgatgagttgaatgattcgccggaaccagttgaggaaattgagtggtaatttgccaattatccttaattaagataaagtcattacctcataaatacacattaatttaactaagtaggtgctcgcaatgctaaggaaggtttggcattgtgagcacctctttgaatatcaaaatcgaatgttgaactttatatttttggataacaatgaaagttgcaaggacagtcaattattgatccttatttttgaaaacgcttgcaacagagcatgtgctgggctaaaataatttttagtaatatatttatattttacttattattggtaaaagaaaaggagctcatctcatgaaatccaaaatcctctttagtgcattactgagtgttagctttggtttggcaatgggtttaaccggaaatattagtcatttcaaggttgcatttgctcaagaacaaagtagtgatagccagtcaactacgactaccagcaagcaaaatctagaacaagatattagacgagccgaaaaacttcagccaaggattaagtcatacgctcaactgagtcagaatcgggtcaatcgatcactcaaaatggcaaaatcacttgtgaacagcgactccgcaactcaaacacagctggacacggtcgatttattattgtcctcttcaatggagaatcagaatttagtcaaaaagaccaagactcactattcggcggttcccgttggaaaaacttggcgagatactcaaggagcaccaattcaggcccacggaggtggctttcttaaacagactgacaagcatggcaaccccatttattattgggtcggggaagataaaaaccacaacaagtctagtttcaacggcatcaacttatactcatcccacgacttattaaactggacataccgagaaacggttattgcaccatcgctgaccaacacaagtttgttaggcaacaagatcgagcggccaaagctactttacaacaagaaaacacacaaatatgttatctggggccactgggaggaccaaagcaactattcaagcagccaaatctgtgttgcaactagtaactctgcaacgggcaaatatacttttgagggccattggcgaccgggatctgatgcaactcatcgaaactggcgaatccgaacgcttgctgatggaacccgtcaagttgaagatagcaacggttcgattatcaatggtgccactccagatgagatgaacaataatccaagcatttggggttattcatcccgtgatttcacgctctatcaagacggcaatgatgcttatctcattacctctggtgggaaaaacatgatgattttcaaattgaatgatgactttactgacgttgataccaactcgatgaagccatacacactgtttgataattatcgggaagccccagcgatgattcattctggcaagtactacttcttaattacctccagccaaaccggttggtatccaaaccaggcatcctattcgtatacgaccaacattgctgatccgaatagttggaccaagccaagcagctcatccccacaattacttggaaataacacggcattttatagtcaatcaacaaacattatgcaagttggtaacaaaaaaacacctgaatatctttatctaggtgaccgatgggacgccaatgcccttggttcttccacttacgtttggctgccactttccatcagcaatcaaaattccggcaacccttccatgaatctacagtacaatccaaattggaaattaaatacttcaacgaacaaaatcaccaacaatcaagacctgttattgtctcaaggcaagcctgcaagcacagatgcaactcaaagttctgattccagtttggcactcaacaatgccaacgatggcaaatatacacaggacagcggttattttaaaccgttaacaggcaacggacaaactgtcaaaatgccgttcagttacactgtggatcttcaaagagcttacaacctttcacgagttgatatctcattcaacaacggtggtaacaccagctactacccggcatacaaggtttatacaagtaacgacaacaaaacctggaaattagctgcagatggctctaataatcaaaatgttggtttcacaagcgacaaattaagtggcaaagcaaggtatgtcaaagtaactgtttcacaattcaatacgtatggcacgaacacacctgccaatgcggccgcaggaattgatgagtttcaggtttatggtcaaaaataatgattagtaactttaaatactttacgtaataacaagcgccaggcaaaatttaattctgcctggcgcttgtttactctctatctcattaaggtcaataataagtcgccacatcatacatcttctgcgtaaaggccttcgcactaatgccccccaccagcggatactggttcataaagaccaatgccatgtggtagttgtcatctcgggcgtagtaactggtatggaaacttgagccgccaaaggagccattattgtatttcaggccatccttattgacgtacaggccgccggaatagtagttgccatagctggtcaattgctggaactgactggctgacaagatctgcccgttttgcaggccctgaacgaatttataaaaatcactcggggtgcttaacaggttgccggcaccgggaattgccgagagtcgggcataagaaaccgcgtcggcatcctggtaattgtatttaccttgattggtgtagccgaccgccaccgttgacttggtgctgggctgcttactgcccacgatgatggtattcttcatcccaaccgcgttaaaaatccggctctgtagattttgggcatagcttttgccggtcaccttggaaataataccggccaacagcacgaaattggcatcactgtaattataagtattctgaccggtcgacttcaggcgctgaatcatgctggcgtacgcctgattttccgtcaattggctgcttggcgtcacatcagtgttatcaatgccagacgtcatcgacagcatttcagcaattgtaatttgactgctatatggcacggtcgggtagtacttgcttaacggtgttgtcggcgtcaactggccggcactgatcaactgttggataatggcgccagtcatcgccttttgcagcgaagccagcggatagacaaccgttccgttgctggtgttaaccacgtttctcaacgcattggcatagccattgctgacaacggcggtattgttgctgccggcagaagccaaaacggctgttccaaccacgttatattgcttcatcatgttactggcaatcgtattgaaactcacagacttgatcccgtgaatattcatccagcccagcttctggttgtagtacctcaataacacgtaagtaccagtcttggtggtcttgatctgcaggacccggacataggcattgttatatttataaccattgccatcggccgtcttggtcgtggcgttggtattgtaaggaccgtcggtgtataaattatagccgcgtttgacggtcgtttgattcacaatttgggcatcgtaatgcttattgctggttgccatcaccgcattataggcagcaaaggccttgtttccggccatcaagcccccaacagacaacaggcccgccaagaataacatgacggtcctgcttttaaacttattcatcaaaatcgttgtcacttccactttcattttgccaatctttagagtaatagtagttgtcaattcggtaatgcggtgtcttgaccttcttcgtcaaaaacggccgaattgcctgatccattttcagccagccccgccagccagggtggattgtgtcggtcataaagtaaggaacgttgccgtcatggctgagattgtcaatgtgggtaaatccttgtgaccgcagctgataagtaattttattgctgaactgatccagcatttttgccgacaaaccggtgtacttctgccattttgcgttaatcggcggaatgatgaataacaccttggtatggtcgttggcaaattggttgagcatcaattggaaatcactatattcaggcgactttaagaagctcatattggactggaaccccttgagtttcttcacgtgggtcttcaatcggcgattccaaaagctgttggaaatttggaaatcatttgaagacgtcttttcggcaccaattttgccagccagctgatccaacttttgatagttgtattgagctggaagcagctcctcgttcttatcgatggtttcctcgttgttcagcgggatccgatatcgcgagaagatttgatcttcattcagcaaaatgcggttgcgcaaattgacatacaacatttgagaagttgtcggctttagaccggcagcgatccgtgccaacgcgccggcaatcaccttgtcggaattaccggaaggcatctgcaagagccgataagcggcataacgatccattttggatccgttctgctgcttaatccaattggtcgtttgcaaagttgaataatagaacgaaaaggcattggggtcttctcccttgggcgtgaaccactggggggatacgaaaacgacggcctttttattttttaactggggattgaccgactgcatgacaaagaaatgcgtcagtgactgactgccccgggcaccaagcaagaacggccgataacttcgtttgtacttggccgccagaacagaaggatgaaacgggtcaaaccgcgaccactctgatgaaccaaagaatgggacataaccatgttcaagtgcgttacgtttaatcagctggccttttaaaacctgcggcgaaagcgatgcggcggcgttgtcgacgactgtgggattcacatagctgaaccccgaccacagcggcgataaaaacacggccagcatcaacagtgctgcagcaaaaatcggcccaaatatcatgaagagccgctttttaacactcatttggctgcttcaactttcgcaataattttagcaggggtgttccactcgtttcgatcgaattctgaaacgggggcttgaacgcccaatttatcttggagatccagcagtaactgcaccgtccccattgaatccagcaacgcacttgagtataaatcttcatccaaattgtcagaaaaatcttcaccagttaaatcttttaaaatatcaagtaccgtttgtttatcatccattatgaacaactcctcttaattaaaatggtttcggtgcaaagaacaatgtgttcaagaatcctgagaaaatcaggaaactgaaacaaacaacgttaaatgtcagaaaaatcgcaaaggcttctgtaaatttgttatgcggaatgtggtcttgatgcttcttcttgaaccgcagccaggtgtcgttgatgaccatcgcaaacccatggtagagaccataagtgatgtagtaccaggtctcgccgtgccagaatcccatgatgagcatgttaatcacgtagcacacgttggctgtggtggttcgactcttgaagatgtgatgcttcatgcagaagaagactaaccgcatgaaaatgtaatcacggaaccaaaatgacagagtcatgtgccaacggttccagaagtccttgatgttcttggatttaaacggctgattgaagttcatcggcgtcttgatacccatcagataactgatgccgacagcgaacaaactgtaaccagcgaaatcaaagaataaatccatactgtaagcatacatgtaagcgacgatgttccaggaaaagccgtgagccatcaacgcccgcatttgaatctggggcatcagtaccgaaccaaagtagtaggccaggacgaatttgtagacaaagccttggaaaacgtagcggacacccttttgaatcatatccaggtaggcactctgctccggcaccttggcataatcagcttcaaaccgccggtaacggtcaattggtcctgaagaaatggtcgggaagaacaataggaactggccaaacaacaccgggtggaattctttaatcatcccatcacgggtttccatgatggtctgcacgactttaaaggtaatgtaggaaatacccataaagccgataatcgattggcgaccaggcgtaaacagcggcgtgagtttgacgataaccaaaggaacgatcgccaagaccaccgcggtgacaaagatccaccccttattaggcgtgtcctttttctgccggtaccctgagtacagccacacgaggatcaactgataaatcaagtaaccactcagtgagatcccggttttccagttgggcccaccaaaggtcaaaatcaggaagaacagcgagataatcgtctggtagccgcggaaccggtgcccatacaacaacccaatcattaacgggataatcgccagcgccagccagatgaagtaggttggattgccgtatggaatgtaccatctcattgactgttgacctcggcaatcactgctttaatgtcgaccttcccgttagagctcaacggcagtgatttttgataaacaatcttttgtggaatcatgtaggccatcatatcctgccccaagttcttcttaatcgccgcggtgagttccaagttattcttgaaatcattttcctgcggtacaacgtaggcaatcagcattgacacggtgtgctgtgagttgtacttgggcaccaccaccgcctgcttgacgtgttcttctttgctaactagtgcggaaacgtcttccaattcgattcggaaaccgttgagcttaatctgaaagtctttccggccaaagtagcgcagcaggccatctgcagccatggtgacaatatcgccggttcgataagcctgctggtcgccgattttaaagaaggcctgagcatttttctcagggttgttgatgtagcccttggaaacgttctgcccgtagatgaccaactcacctttctggccatcggttacctgaacaccattttcgtcgaccacctgggcattcatgccgggtttaaggtagccgattggcagccgctcatagtgattcaaaatgtcattggtaatttcaatttcggtaattgccaccgttgattcagttggcccatatgtattaaaaatatgagcagccgggaaccgtttgttaagggcagccgcggtattgtgggttaattcctcgccgcagaagagaaaatcatgtaacttcggataatgggcctgatcaaaagttgattccagcaggcaaatgtcgacaaatgatggggttgaaacccaggtgttaatcggcatcgtccgcagtgccgtgaataagacgataaaattatcggtggtctttttggataagacatgaagcgtgccgccttggaaaagtgttggatacaggctcatgaccgacaaatcaaacgagtaggccggctgctgaagcatctgcagatcctttggcaagtcgaaagcatcactcaccatccagtcgacaaagccggccaggttgttgtaactgatttcgacaccctttggaacaccagtagttcccgaagtgaaaatgatgtagtaggtttgatctccatgaaccggatgggtcagtcgataatcaactttttccaggcaaatgtggtcgagctgttcctgatcaatttctggaatatccggcagtttctccggtaatggctcagtcgcgatgaccgccaccggtttggcaatctgattaatcatttccaaacgttccttaggtgaattgatgtccaccggaatgtatgggtgaccggatttaaccgccgccaaaaatgacacgatcatcgtaaaggccttgccgccaaagacgatgattggctggttcagcggtagtgccatcgagtcgatccgctccgctaaagcatccgagtaatctttaagttcttgatacgtgtggttctcgccatcgtaggcgtaagcaaccttatccccctgtttttgtgcatgtgaatcgattgttgaaatgagcgtttcaatcatctggttgttcccccttagaagtcgttatagataaatttcgcttgattaatgccgctatagtcgtagaggtaaaaaagaaccaacatgatcgaaaagtagatgagcgtcgtgatcgtaaagcgcacccacggcttttgcaaccattgtcgtactggcatatgatcatcccccttgttaaatgggtaacgtttcgtcacccatataatatcttgttttacagcgctttcaatcaaagcgacctttcaatttttacgttgccaggtcgtcaaataacctggcagctaagttttgaatctggttggccggccggtagtcgttgctgagtaaaacgacaccggatttgccattacgagtgatgaacaatgacgattcatatccgtagccaatgccatgggagtgaatcccgttttgctggttataaataccgccgccatacggggcattgagacccggctgatgcaaaatggctacgctggctttcggaataatctttcctttgaggatcgcctgctcaaccttgaagaggtcaaacggggtcatgaaaacctggccggttcccaattcattttgcatcgatgctttggcttcgtgatactgcctgctataattttgtttcagttggttagcagccaaccagtggtacccaagcgtccggttcggtcgagtgccccaatgttgaacgaagccggtccccttgaggttcagcggtttggtaaacagctgatcgaaatatttgccgtatgacttgtgggtaattttggaaataatccccgccaatacgacgaagttgaccggttggtaccagtccttatactttggtgatcgagtgacgatgtggttaaccgcgtacttaatgacgttttcttcattcagtgtgcggaccgaaccggcctcactcatcgtcaaaccggaatccatatccattagattgcggatggtgatgttccgggaattggcaatctttggatagtacttcgacagcttggtgttcaatgacaacttgccctgagtgatcagcttcattgccattaccgccgtcagtgatttttgaatggatagaatttgaaattccgagctgggtgtatttgggatgtctgatttgtaattggcataaccgaagccctgctggtagagaatgtggttatttttgacaataatcgccgagccgacaaagtgattacgcttcaggtaactggtaatctgcttggtctgctgggtcgttttgtgctgaatctgtcttggcgccgacttttgtgtgcttgcctcccgcttcttagccgttgagctgagctgctgctcctgcctgcggcgattggcacgtttggccgcttgttgcgttcgaaactcctggttgttagcccgccagtacatggccccgcccacagtaccaacaaccgccaggataatcagtgttatgtataagtacgtgcgcccccgtttcatgggctcacccccctttaaaaaccggaaacacggctgtaaaccgtttgtaatattccagtaacatttaattaagtccattatgaacaaaccgaaataaatggcaacgatttcgcaggaaattcagccgccctttagctaagttttagtttcttgagaatttctttaattttcggtgatggttttggcatggtttttcttcttaaatcttaataattaagttatcacctccgcataacgattccggaaacgaatggataacaaaacgcccctgatcgggagttccaagcatttggatgctctcaatcaggggcgttaatgattaacattttagtaataagtagcgacaatattcatcttggcaagaaatgccgaagccgtcatgttgttcttcagtggtgactggttcaagaagaccactgcgacgtgctggttgccgtctgaggcggtgtagccggtgttaaatccgctgccgggataagttccgttattggacttcatccctttttgatcaacgtacatcccaccggaatacttggtgctgtaactggttagctgctgataccccttggcagtcagcactttgccgttttgcaggccaataacaaacttgtagtagtcatttggcgtcgtcaaaacgttgccggcgccgggcagcgctgaaagggccggataggaaaccgactgggagttccggtagtcattgccgttggaactgctatagctgacagccttaatcgccgtcaaatccggttgggtttcgttaatcgcattggtattcttcatgcccagcttgttcaaaatccgcgactggagattcttggtgtaggacttgccggtgactttggcgataacgccagctaacagaacgtagttgatgtcactgtagctgaaactgtgtttgttagtggacttcaaagccttaatggcgttggtgtaggcttgatcttcggtgacctgatcgtcaggcgccttgattgttcccttgatgcctgaggtcatggtcaatagctgctggatggtgatcgtcttgctgtgggcgacttgtgggaagtacttgctcaaagtcgtggtggctgtcaacttcttggtgttgatcaattgttggatcattgctgcagtcatggtgttttgaagtgaggccagtggatagagaaccgacccatcactggtattcttggtgctgtggagcatgttggcatagccgttgttaaccaaagtgggttgcaggttcttgttgtgagaaaccaggacgctgccaacagcattatatttttgcatggtggcttgggcgattgccttgaacgaagtctgcttaagtgcattggcgttgatccaacccaaaattttaccattgaggcggatttgcgcatatgtaaccgacttggccttttgcgtctgcatcacgcggacgtattggttgttgtacttgctgctgtctgttgtagtcgttggcgttccggtggtgttcttgaccccagggacgttggaataaatttggtagccgcttgcaagtgactttggtgtgataatttgggcgtcgtaacgggtggacgttgatttagtggtgctggtagtggatgatgctgtggcactggcgctggtcggctgggtcgtcgaaatgcccagcaagagcgctccggcagcgattaatagggttgcctttaatttatttttggtattcatattttcatcttccttgttcaaattgattggttcgccaaagaaattgtaacactgttaatgaatcgggtcgtcgccgggggcggatttttgcccagattcagagtttaaattgtaattttaagaaattctcagagataatgacgataaacgagttttgtgccgtatctatctagtatggcctagctggcaacatttaaatttgcaattattcgtcactttattcggaggtattttatggaatttcttgaagtactattaggattgggctatatcggcctcatcattgcagcgatttatttataccaaaaacgacaaaagcaagagcctgcaccgtttggctggaagtacctggggattgccttctgtgtgttatttgtgattgggatggccacgggcggaacccagtcagataattccagttcgactcaaaccagtcagcaagccgactcagcgactgaatccagtgcgtcagaggagtcgttggatgaatcaacggaaaccgaggaacccgggtcatcggaatcagaatcagatgacccggacgaagatccttatgccgctttgtccgcaaaagaacgggatgagtttaaccaaagtctggatgatgagttgattcaagaccaaaaggaggccgaaaatggcgagaatgcctatgcttggtcactatttgttggcggaattgtttatgataagcaacgcggctttattgttaaagtcaatgacaatttccagcaactcagcaatgcaaataagacgatcattggtcacagtgtgcaaagcttcatccaatcccagctgctgatgatcggcaaggacgttcagccggatgatccctacccgtatatcaattttcactatgggtatgatcgggttggcgattcacggatgtgggatcctgcgaagtttaaatttagtgagtcttaagggacaaatcaaggcttagtgagtgtgttgactcgccaagccttttgatttgcgccgtttatgatattaatatgttttaccatcatcgcacgttttgggtactgactggcaaaagtggccaactaaccccggaaaccagcctaaattcaagtaatctcacaatgagattggtataattgaagccagataacacaagaaaagagtgattatattgaggggaaaaagttttgtcattaccgctttaagcggcctgatggttttgggagccagtgcggccatcggatttgtgagtcaggcggcaaccgttaaacggaccgtcgtcaacgtgacgttcaagcccagtaccagcgaggctgatttgagcaactacgtctacgacacggtcgatccaacaagtcccaaccatcatcattacttaacgccgagtgaatttgccgacaaatttggccaatccaccagttacattcagtcatttaaagactatctcaacaaatatcatattcgcagttacgcgtatcccggcaatttggcaatgaagctgaccgccacgccgaaaaacatgcaaaaggcttttaacgcaaaatatgtcaaaccggccaagaagggttacgaagccactaccagctataagctgcctggcaatttatcaagtaaggtggttgccgtaatcgggctgtacgcgcaaaagccgactaaaaaggcgactgcaaagaaaacaaccaaaaaagcagctgcttcccatgcattaatggccgatttgccgatttccaaccagcagccaaacaccaacgtttcagcaaacaccttttcactgaagtacggtgccggaaagtttgccaaagcctaccaattgaatcccctgtatcaaaagggtcttcagggccaagggcagcggatcggtattatcactgttagcgacattcatgacggcgacgtggcgacctactggaagcaatccggcattgacgctaatgtgagtcaaattcaccaccactacctcgtcaatccaaaggccgaggtccaaaagagcgtcaactatctcctcggcagcccgcagaccgaaacaacggttgacgtggaatcagcctcatcagttgccccaaaggcagatattgatctctacattggcgatgacaccaatccaaatacatctgacccttcagcgatctacaccggcacgatgtcggccatttccgacaaccaggacaagcagctttcatcaagcttctcggctgctcctgaagtgaccgccgactggggcgatccaagcgcaaccgtcaaacaaacctcagacgcgtttaacttaatgtatgaacaggcagccgcacaaggcattaccgtctttcaggccagtggtgactatggcccggttagtcaaccgagtgccaaggaaaaccatggtctgtcgacttccccttatcaggtcttagtgggcggaaccaccttgccataccagaagattctgaataataaagtcattacggtttccaaggaacgcgcttggggcgacacgtacgctcagaccgccaatgaaaaacagatgggtatctttggcggcggtggcggcggcttctgagctttgaatccgacccctcgttatcagcaaggggtttccggtgtgaatacgtttagagcggaaaattttctaacgtataaaaacggcaagttcactctcaccaagcatccccacattatctttggaaccggcaactcacgcaacattcctgacgttgccggcaacgctgatttgcaaaccgggtatgcgacctacgtcacaggaaaaaatccagtgctaaagggtaaaaaggtccttcgcatcccaagcacaaaatggctgattggcggcggaaccagttacacctcaccacagatggctggtgccaacgccgtgatgaacagcggccgccaaaccccaatcggtttctggaatccgcaaatttataaatttgctcaagagtcagacagtccgtttaacgtcctcgatgacgctgataacaacaacaatttgtactacaccggccaacctggcaagatttacaaccaggcgagtggattggggaccattaacttcacgcagctttacaataaatttgccgatgaaaccaattaatttggagcagaaatactcccgaccaagtagacaattaaataattaaaactgttatgcagtttcttcaacggcatgattgtgatattctatcgggatcatgccgttggttattttttgtcgtttctgactagtcccactcaaaaatttaaaagtatattattgtaaccgcttccattccggcatacaatatgtgtgcattaagaaaggatggatattatgaacgttaataaagtcgtcattctgggcggcggggttctcggaagtcagattgcttatcaatccgctttttcagggttcccaaccgtcatctatgacatttcagatgaagccgtcgatagtgccaagcaaaaagttgccagttatccaaaacagtatcaacaggacatcaacgccaccgatgcccaaattgacaccgccaacagtaatctatcactcaccactgatttaaagtctgccgtcactggtgccagcgtcattatcgaagccgtcccggaacgactcgatattaaggaatcgacttacaagaacctggcgccgtttatcgccgacgatgcgctattgttgacgaattcatcaacgctaattccaagtcaattgattgattttgtaccaaataagcaacgatttatggcgatgcactttgctaatttaatttggatccacaatgtggctgagataatgtgggcccctgacacccctcaatcaaccattgacgatgccgaagattttgccaaacaaattcacatgatcccaattttgatcagaaaagaaatctctgggtacatcatgaattcaattttcctgccaatgatcaatgccgcactatctctgtggacaaatggcttctcagacccaatttcaatcgataagaactggatggtcagcatgggagtcgaccgcggtccgtttggattccttgatatcatgggactcaacaccgccgtcaacatcgaaatgggattctatgagaataccaaagacgagacttatcaaaagattgctgataaactcaatgaactggtcaaagccaacaagctgggggttgccactggcgaaggcttctatcactatccaaatccggaataccagaatcctgatttcgtgaaagcttagtttgttcatatttgaaattcgagaagaggcatacctccaaggtttatgtgatcgccttgagggtatgcctcttcttgaatatttttaaataccagtttatgattttcataattggaaaggatgattaattatttcaaaaaatgttcgaatactaataacatactgggcaaactttatcatcggcttaagccttatgctgtggttcgacgacgccaccatctatacatatctgtttaaactgccaccagttagtggtatcggcgctaattcatttcaactgaccgtgaccttattggttgacttgctgctgtttggactcatcagcgctgggagttattatttggtgaacaatcagctgatcgactaccgtatcccccaacgctattcggtttggatcgcatgggtgatcatcgccagcgttgtcatcacaatttgcttaaaccttcttaataccacttttgtcatcacggccgcaattgcggtgtttctcccgctgccaatgctaattgccatttgttcgccgattattgctagtcgaggtcggcgttggtttctgctggggctcactttgcaaattgcctggggtctcttgttaattgaactatggtttggatcacccatgtgaaagacacatcattagtatgctttgtcataatcactaattttctgatactggttggagattgaattgatctccactggattatcgtcgtcatcattcttcacaacgttggccgtatagcggaacacttgaatgtggtagtggccgccggtgtcaaatcgatacttcatgtcataggtgacatcactgctgttttgagaactgagcttgatggaatcaacggtagcggaaacatcgatcccgtccaaatcatcgttttcataatagctcttccccatatgtcggaattggccaaagtatggactcgaatcgccgccaacaaagaatgaagacatgtcatcgccatcatcgtccgtggcatcatcaagatcaccactatcactgtaactggtcatggcttcggataaattggaaaacaaggtgtctgcgtcatcatagctgaccagtcccttgaaaaccaatgaaacatcgtgatcgccattggacccgctaatcacccgaggttgagaagaaatcgactttttgccgttctgataaactccttgaactttcatttcctgagtccaagggaaatccttgaaggccatgacaccgctgctgccaattttaccctggtccttcgaattaatctcaacgtgcgtgccggcagggccggtgacgttaaatgaaaccgtcttgagggttagcgggatggtccgactgctgttgaggtgataggtgttcgtattggccaatttgtggccgtttaggttggccgaactggaaagttggtaacttccgggcaccaagggaccaatcttctttgaaaaatgtggggtgttcgaagtggcaatcttggtgccattctctttaatctgcgcattcttctcgttaacagttagggtgacgtagactggtttaactttgaccttccaatcaggaaaaatcaaaaacttccggccggccttttgatagctgagccgttgattgtcaaaggttcctaatccagctgattgagccttaaatgccaggagctggtcgggattctggttgaagtatttggtcagcggctgcagagcttcattcgtcagcttgaggttgcgatcgttggtgtaaaagtagcggtgcaagtcgctttgattgtttttcaccgcggcaaccacccgccgtaacgtgctggtcttggaatagtagtactcgccatatgtaatgccgccaattaccaagatcgcaattaggacgcccaaaaagatctctcgtctgcggcgcctctgctgtttggttctgactttctttctctttcgaccagctgctttggccggcttggagacagccgttggttgatccggcatcgaggcctgagtttcctgccgatacgcacggagattgtacccacaatttgggcagaaatcatcgttgacggtcacctgctggccgcagttggggcaaaagagtaccgccccgtcatcagttgaattgtttggtttcatggatagcatcccttcaaagatagtaaataaatctataacataattattatagtcctttgatgaggggctgtcatactgaattagacctaaatgttagctgcagaccgatttttaaaccagttcaatgagcacaccaaaaaggcagacccaactaggatctgcctttttgacatacgattaatacttcccctgaatcaccaatttcttattagcggtgacatggtacccattactcaatacataacgggtagtcaaattgtgcttaactgagctcttaactttcaggtgcgtgcctttcttgtatgacttaacctgcccagttaaattcttgttcttgtaggcgtgaacacccttcttggaaataacggtaattacgttgccctttggcattgagcggtagtataccggacggacgtgggaccacttagctgtgatgtagccgattttgccatcggtcttgctattgtggttgacgtcacgaactttgtagcgaagtgcgccgccgtttgaccgtgcgtaatcaatcacaacaaacattgggcgattaatccgcttctgctttgggtaacgagccatgcgctgtgccttcttaaaggttggattttggtagaggtaaatggtcttgagggcgtaaaccgctgccttcttggttgccgcatagttcgggatgttcggtgttgtcggcttagtgggttcagtcggcgttggtgctggactcggggttggcgtcggttgtggtgccggagtgatcggtgctggtggagtgacgcttccgccaccaccgccacctgcggccgggatcgtgacggtcatcgttgccttttgatcactgccatagaagtggtaggtaaccgtgtaagtgcctggctttgaggtatcgatgttgccgccgtcaatgaccagcccttcagcagctgcatcacagtatttcgtaaccgaacggccttcaggtgtaatggcagcgatgaagtgctccgttgcatcaaatttgtcacccagcgctaaggtaatgcttggcgtgacggtcaccttggactgatctttgaaaccatcttcgggaacatacagttctttgggaaccccggcggctgcatatttttctaccagactgtcaggatcaaaggtctggccagctgcttctgctgttgcctttggaacccaggttggtgcgatcatcatcccactaggtcttggaatcaacatcctaatgttattaaccaagacaacccaaaccttgaatatcgacttgtggaactactggcattttgccttcatcggatcaatcgtttcgatcgcaaccagaagtttcctgtggggcgtgtttgccgcgaccatcaccatcatcgtaaccttggttggtgccgaccgttcacagaaaaaagttgaagaattctatggtgaagatttaaagggggtatcacttccccaggcattctgtgtcagcttcattccatttgctatcgctgttaactggattgttgaaagaattcctggtctcaacaaagttgacttcgatgccaagaaacttgaaaagcgcttcggactgttcggggatccaatcctacttggtgtgatcatcggaatcattcttggtctgcttgccaaatatccaatggctaagactcttcaattaggaattatcttgagtgccgttatggtattgattccaaaaattacaggtatgtttattgaaggtttaaacccgatctcgacccgttctcaagaactagtcagcaagaagttcaaaggccgagccttcaacattggtatgactccagctttggtaattggtcacccaaccactttggtcgtatcacttctgttggttccaactattctcttcttatcagtaatcgtcccaggtaacgaattcctaccacttgccagtctatctggattgatttacattttcccattggttcttccatacaccaaaggaaatgttttacgatcattcctagttggtttggtcagcctggttgccggagtcctttcagccactgcactagcctcaatcttcacttcagctgttcggatggtgcaatcaaacttgattccagccggcacatcatcagttgcaagtattgattttgcagctagtccactggcatggatcgtttatgaattcactgccaacttgactttagttggaccaatcgtcatcgctgtaattaccttaggtctgatggtttggaaccgcaaaaagattgctgccaatgacgttcaaaagtcagtaaaagaaccagctgcagtccattctgaaacgacaaattaatatattgatatgaaataatgagctgtactctccggttaagtaataccactaagagagtatagctcattattttcccaaaatattgcccattaccaatcagtaagccaaatcccccaataatgataaaaaagtacattggcacttccaaataataagcgtaaaatcatctgtgcaaccgctttaattaatgcaaatggaggttttacaatgacaaaagtagcaatgattaccggtggtgcccaaggcatcggtgcagagatcgcgcgtcatctatcaaaaaaaggatacgatattgcaatcggtgatttaccacaacaaaaggaaaaggctcaagctgttattaccgaggtggcttcagctggccaaaaggctgtctttatccccgtcgatgttaccaatcaggcgaatgttgccaaagctgttgacgatgcagccagccaacttggtggctttgatgtcatggtcaacaatgccggggtagcaagagttgacaaatttgaagatattaagccggaagacctcgaatttagttttaaaatcaacgtctttggtgtcatctatggtatccaagctgcagccaaaaaatttaaagaacttggcgttcctggtaaaatcatcaacgcctcgtcaattgccggaatgcgtgccttccctgtttgggcaacctattcagcaactaaagcagccgttattagcatcactcaagctgctgcgaacgaattcgctgccgatcacatcactgttaacgcctatgcgcccggagttgttggtacgactggcatgtgggacgaaatcgaccggaagatgtcagaaattaacgggaagccgcttggacaaaacaagaaagacttcattggtaccatcccactaggtcgaactgttgaacccaacgatattgcaaacatcgtggaattcttagctagtccggaagctgattttattactggccaagcttatgccgttgacggcggtggattgctttaatttaaatttttacagttaacaaatttagcaccataacaatagcggtttgtgggaaactatttccacaagccgctatttattggttctacaatattattaataatcccttaaatgcctcgctcacccgctaatcacaaatatcgtacaactcactcaaaaacttaggcagttcacaaataacttcatccaaatcactcccaaattcaacgtcatcatcagcgtcataggcgcttaaagtccgatacccaatttcatcaagaaagcgcaagtcttcagttaacccgtacagtttcttagcccacatgggtgaaatcatcgtcatgccttgatgatctaaatacttggcagtcgtcatggcaccagcactgataattttgactaaatcctcatgcaaaattttaactctgagtaatttaagcaacccaatgctcaaaatactattgagtaaacaactgtaatagttttcagaaattaaattacgcttcaagtcattccagttgaggttgctaattgccaaataatcatcaccatccagtttgacctcaaaaccattttgaatcgcccagaaaatatctctcttcaatttgccgacggtgccaaaacccaaacctttaaaccgatcctttaattcaggttcatcaaaaagtgacaaatgcagtaattgtccagtttctaacggattaccaatcaccttgactgaatgaatattatttatattatccagttgtgaatcaatatcctggttgtgaagctttttttgctcgtcttgagtaatcgtttgaagcggatcgttttcgttatgaggcgcaaagctgaaatcttcatccattgctgtatattcaccagcatgcttttgtggtaaataattcgatgtgaccaccggccgcttattgatgatgtctttgcgaaagtatttggttgaaaaatacaatcttgatttgggatccgtcagcaaatcatataccccggtggttgaatgcaatttggtcagactcttctccgtaactggcataaaaaattgatcaccggataacaacccattttcaccattagtctgtagttgattaatgatttggcacatattaataagtttgatattttgtggggttaactgtttcaagatatctttattttgactatcaaccaaactgtccaaataggcagacactggccccaaaattgtggtttgggcactccagaaatagttactctttaataaattttggatgatcgcctgagaagctacttgattattcaacttttttaaaggtttgagggttttaggtaatttctttaggggcttatcatccgattgccccaaatcgtttgcacttgggttaataaaagtgtcgatctgtttcaatgtaatcaagttggtttttttatgagccatatttaattaataccaccttattgaaagagatttgtatgaattggcatctacgtaagctagtctagatgcatcatcgcagtccgtctgttgccaatgttctgctaagtaaaaagtgtcgtgcaacaacgttcttatcaactaatgatattatctcatacaagataaagaagcgtgtacatgacttacatacccgataagcttagaaatactcatcacgcatcttttcataaataatcaatcaatatacaaaaaagctcaactaatcattctgcagaggataactcctcaaacaagaaaatcagttgagttatttagtttaaagattatttatccggtaactgcaagtcatcaaggtcgcaagttaacaaccgtcaacttctcccgtgacatcgaaagaatactattgtgaacgccttgagttcccattccggatgccttaacccccaagaatgggaagttgtcaggtcctcttgatgggcgaccattcacttgaaccgttccaacttcaatggcgccagcagcttccaaggccttgtcaatatcctgggtgaagacactggcctgcagaccaaagttggacttgttagcaatcttgatggcttcatccaatgaatgaacccggatgatcggcaagaccggcccaaatggctcgatccaggcaacgtccatgtcttgggtgacattatccaataaagttggcgtcaataaattaccatcgcggtggttgccggtaaccagggtagcgcccttgtccaacgcatcatcgattaggtttgaaacaaagtcggctgccttgttgtcaattaaaggaacgatggtgctgttgtcggctggcgagcccacgctcaagttttcaacggccgtttttaatttggcaactaactgatcggcaatcttgtcgtcaaccaaaacccgcttaacggcagtacaacgttgacctgaatacgagaatgccccaccgataatgttcttgacggtgacatctaaatcggcgtccgaacagacaattgccggatcctttccaccaagttccagaacgagtggaatcataattgatttttgggataatcgtttaccggttctggtacttccggtaaaactgatcatgttaatgccggaatgctccgtgagataatcgccaatttcagaaccatgacccgtaaccagacttaacaagccctttggaagcccagctttgtcgagcgcttgaatcatcttaatgccactaattgaaccctgagtggccggcttgaagatgactgcattacctgccatcaatgctggagcaatcttggaagctgacaaattaactgggtagttaaatggcgaaatggcgagaacaacgccaagcgggacccgttcgataatccctaatttttcttttgaaccgcctggaaagccatcaccacggacactctcgccgtgcatatgtaaggcttcctgaacagtgtagcgaatcaagttaatcgtacgaacgacttcgcctttagcggctttgtaattcttaccaacttcgtccatcacagcggttgccaagtcgtccttttgattatcaagttcgtcggcccacttatttaagtaggcacctcgctcacttaatgataacttcgcccagggcttttgcgccttccgagcagcctcaatcacttgatcaacctctgattgggtaacagcctgaacccgaccgatcgtttcgtgccgccatggcgactgaattgcaatggtcttattggattcactggcttgccagttaccagcaaaatatgccggataagtggttacgtcatttttgacgatgtccataaaaagactcctttcacaacattttcagaataatttatgaaaatgaatttgtttcattaaagtcaattttacaaccggttgaggttaaatactagcagatagttggaatcgctgctaataaagcgtttacaattcgttttgagatttcttggagacagtattaagactgatttacatcagaattttcagaaaatacaactagccacgacggattttttcgtgtgttagtgataatttaatgaaaactaatctccaaagtcagcatgctccttacatcaccgattatcattgaccttactctgacaatttgaatttacctgaccgcacaagaaacccccttgaattggagaaatctaattcaagggggttcagtttttctattttctcgttaaaaaatcatcccaactagcagagccgtcactccaaactctcatccacaatcgagtcaacaaccttctcaatcgcactcactaacgggctatcgggctgaatcccagtgtccgcaaaccgttcctcccaccagtttttccgaatcgcctggatggttggaatcacctgctggccggcagccgtgagactcaagatgattgatttgccgctcccggctgttttcgtcaaataacccagtgcctgcatctttttaatttctcgagtcgccagtcccttatcgatcactaacgacttggccacctggttctgattaatctcggcattatcattaatcgtcaataaaatacaggcagccgttggattcagctgctgctccttaaaaaacttaccggtatccttgtaatactgccggtgcaaaattgaaatatcctgtgcaaggtagccaatatctttcaaaatcattttcctttccattcgtcaaatcctaccgtaagattatcattttcctgttgacaattcaacacatgccctttatctttaaatgtaagttgaattgtcaacataaaaatgaagaggtgtcctccttatgacaaataaaaaacgtggttcacaagctttaattcaatccatgatcaatcaacaggttcaatatgtattcggcatccctggtgccaaagtcgatcagttattcgaagatctccagtacagcgaccagcccaatgcaccaaaattgatcgtcactcggcacgaacaaaatgccgccttcattgcagctggcatcggccgtttgacaggtaaaccgggagtagtggccaccacctccggccccggggtttccaacttggttacggccctaatgacagcaaccgctgaaggtgatcccgtggttgcattgggcggacaagttccccgcgacgatcttgcccgttacacccaccaaagcatccccagcaaagaattgatgagcgttgcttccaaaagcagcgttgaagtccaagattccaacaacctttccgaagccttcaccaacgcctacagcacagccatttcgggcaagcccggcgcttcctttctttccctacccgcagacgtcttaagcggcgaagtcacccgcccggaaatgcaacaactgcaagcacccgagcagactcaaacatccgccaaaacccttgaccagattattaatttactgaagaacgccaagctcccagttatcctggcaggcatgcgggcttcttctccagcggtcacagaggccttgcaccaactgctggcaaaagtatcgttgccagtagttgaaacctaccaaggtgccggcgccatttctcacgaatttgaagcggattactttggccgggttggcctgttcagaaatcaaatcggcgacaccctgctcaagcaaagtgatttggttatcgcaatcggttatgatccagtggaatacgaggcccgcaactggaacgtggaacacaatgaccaaattatcaatatcgatacggtggccccggagttgaccgtcgattatcaaccggatatggtaattgaatcagacattgccggaaccctgtcggccttaaccgatgctctgccagcaagctaccaccttccgaaaacagcagtcgatcaactcaccaaactgcgatcagaatttgacggtcaaagcaccactgcaacaactgccaagcccggtaccatgcatccacttgatatcgtcaatacgctgcaggaaaaagtcgacgacgataccacggtgacggtggatatcggcagtcattatatttggatggcgcgtcacttccgaatttatcgcccgcgtcatttactgttcagcaacggtatgcagacactgggtgtgtcactgccatgggccattgccgccaaattggtgcgacccgatgaaaaagtcatctccgtctccggcgatggcggcttcctgttgtcaggtcaggaacttgagactgccgtgcgattgaagctaaacatcgttcagctcatctggaatgacggttactatgacatggtgaaattccaagaagaagccaagtatggtaagaatgccggcgtgaagttcggcccggttgattacgtgaaatacgctgaaagctttggtgccaagggctttcgggcaaccaactccgaggaattagccaatgcccttgatcaggcacaacaggcagctggaccggtcatcatcgacattccagttgactacagtgacaacattgaactcaaatcagctctattaccagacatcctaaactagaggaggataacgatgacaaaattaacaactttgtatcagcacggcactttggcattactggtccccggcctactagaaggcaccctgacaatgggtgacctactgcaacacggcgacaccgggatcggcactggcgaaggccttgacggtgaattgatcattttagacgggacgccctaccaagtggatagtgacggcaacgtgaatgtggtcccgaactccttcaacatgccatttgcgaacagccacttggctaactattcacctttggcagaactggaaaatctttctcaagctgatgtggaagaacagctcatctcacttacccaggccagcaacacgttcttctcgatcaagatcaccggaagcttctcggccgtcaagacccgggcagtcaagaaatcaacgccgccatttcaaacattggctcaaacggccaaaaaacaaagcatcttcacccgcgaccaagttgaagggacactgatcagctactactcgccagccttatttgacggcgctgcagttgctggattccacaatcatttcctttctgccgacaagacatttggcggtcatctgctggacttccatctggataagggccacgtggcttaccaactgttcgatacgttggaacaacacctgccagtcgacaatcgtgattatatggaccatgatttttcagtggataatatccaagatgatatccatgaagcagaaggttaacaatcaatctctaattgctcaccagaataaaaaaggctctacaacacctgccaccagcaatagataaacatctattaacgacagatattgcagaacctttttattttacttgagcattatatgagcaagcctacttctcagcttccccacttccgggtgtctcctcacctttcttgacagtgtaggacttagcacccgttccagctaaactaccgccttgggcaatcaggtattcaggacggatcggtttgtcctctaagaagtcttcgagaatttcccgagcgccggctgcgtatcgtgcctgggcagataaagttgttccggacatatgtggggtcatagcttcattcggcatggtccgccaagggtgatcctttggtgccggctgtgggtaccaaacatccccagagtagccgccaatttgaccagaattcagggcccgcacaatcgcgtctcgatcaacttcttcaccacgactgttgttaacgatgtaagccccacgtttcatagtagcgagcacctcgtcgttaaacaggtggtaggtctgagcgtgcagtggtgcagctaagacaacggcgtcaacgactttgaccatttcatgaacgtcagggaaataggtcagtcccagctcattttcaacttcatcaggtaattgatgacgctggttgtaaactaatttaaccccaaatggttttaaccgttccagtacggcccggccaattcgaccagcaccgatcacgccgacggtcatgccttccaaatcataggcccgtgaaacggcgtcagcgatgttccagccgccagctttaacaatgtcgtgagccggaatgaagtttcgaactaatgccaataactgcatgacttcagcttcagccacactgacactgttgctataagtgacttcggcaacggtaatattgtgctcattggcagcgttcaaatcaacgttatctgaaccaatcccggcagtgatcgctaattttaatttcttggctttatcaattaaatcagctgtcagataggctggccagaatggttgggaaatcacaacgtcagcggttggaagttccttttcaaatactgaatcggggccttccttgtctgaagtgaccacaaattcaacacctttagattccaaatatttcttcagtcccaagccaccagacacactgcccaataactcacccggcttgaagtcaatcccctcaggtgtcggaaccgtcgagccatctggatagtgggtaatctttggaatgtcgtcccgcacatattttggtgggaaaccatccactggatctggatacagaactgctaacactttggtcattgtaatcgatcctttctaaagtagaaccaacaagttatctcaacgcccaaagtttagcacgtttgtaaacgtttacaactaactgcacttattttttcaaaaattgtcagcaatcaaaaaacaggtctagatcgctggttaatcaacgatttagacctgttgttcattcaacaataggctaaccttcaaggaatgccttggtcttatactcaggatcaggatacttgtagaagccttcgcctgactcaacgccaagcttgccttcatccagcatcttcttgaaagcatcagcaagcggcatcacagccggatcctttttggcggctgccaaagtaatgttgtaggcagttcgaatcccaaccgcgtccaggatgccaaatggtccccatggtgcgccagttgcggccatccaagtccgatcaatcatctttggatcagcgatccctttcagccacaatgcccccgctgccgcgttcaacggcattaacagtgagtttagaatgtagccgggctgctcttttttcagctgaatcggtaccatcccgatgtcccgggcgtactgaacaatttcttgatagattgccggatcagtttccggtgatcccataatttcagcggtgttgttcaaccaaacctggttggaaaaatgcatgttcaaaaactgctttggccgaccagtatcagcggcaaacatgcttggtaccagcgtagatgagttactagtgaaaatcgcattgcttggtgccaacttgctcaatttttgatagaattcatgcttgatgtcgggattttccggaattgcttcgatgaccagatcagcgtctttaactgccgccgctaaatcatccgtaaatttcaatcgactaatcccggcattaaattcttcatcggtcgccgcaatatcatgtcgataagcatggcgcagacctttgattcgttcctcagctttatcaacagcttcttgactaatatcataaacagtcacgtcaaaccctttaaaggcactttgaaacgcaatctgactgcctaagaccccactaccagcaacagtaactttcttgattgccatgataatatcccccttatgctaatggaaacggttacattgaatacactttaattatggcaggttgcttgtgaaatgcaacgaaataggcttggtaattcgggaattcaagctgagcaagggacatcccgtcaatggccgacggttaagcttgaaatgcccaaagtctaatttgagactgactctcaaatcgggctttgagcatttttgagtgataggctttcccatgaaccataaatccccagatccacgaaaccaactgaagaatcggatgaaaaagaacagactgaataatatcccccctgttctggtgtatacccgcgatatgaatatattgagtctgtcatatttcttctcgccctgtagaatcaccatcaaacgcttcgtcgtgttggaagtgaaccgcatcatctttaaagggattttccattttaggaatatacatgaacgacccatcttttcctttaatggccaccacttccgttcctgacttaataccaaacctcttaggaacagttacaacaagtgagtttccttgttctcggactttcatgattaaacctcccatgtatttactttagttatatcatagaatgcctttttcaaatcaaagagcgtcctcaactcaaccacgaatcataccaaaacttcttcttcgtaatcacgtcttgagccactttggccagggctttttctttggcgtaaaacgcatccccggcgaccttctgctgaaaggcggcagtcaagttagccaactcctctttgtcggtaaacacccatttcaaagcatccaactccgacaggatcagcaccaaactaacggcgtcctgactgattttcgcgccgtcaatctgattgcgcagataatcctgaacctgctttcgagcagcgtcctttggcagatagatgacgtgggtgtccaaattattcttgaccgacttcttctcaaccaactgatccgccagcagacctgcgccaaggccgtcataaagctggttggcaatatcccaactggtgataattgccaattgtgtctgcaggtcatgtccctccttaatttcatcagtcagttctgatttgaaaacactcagataatccggcaatttggcaaactcttggtcatctttgattgaaatagtctccccaatgtccaaaattctttggtcgaccaagtcaaataacgccgccaaaacaaaatacgcctgggcagtaaatcgcgttcgcagcattggcttcttaccgattctttcagttaataacaaataatttttcgcggttgtcagttccatgacggatccctccaatttgaataaacgcgtgaatcaacatttcaattttatggcaaaagatgaaagaaccctagtacttattacaaaaaaatgaaaagagttaccttgaccgcccacaaaaataatggtgctatactcagcataaaatccaaggaggacaatgaccatgaacccgcggttgcactatcttacccgttcgatccttttgcctatcgcactattaatcattttgatgttcaacacctccgtccgagcagatgcaaactcagcggatggcaaccctcgaccagtcatttctgacgaacttcacattttaaatcagaagcagatcagacaaattaaacaaatcaatcgccacctgatgaaaaaatacgagggtcagcaaatttggattatttcaacgaataaaaccctcgccgatctgcaggatccaaaatttgaacgatacctcgtcaatatcagaaaaaagggcccaaccgtttcccgattctcaatgggcaacaatccgtttggcgattactatgctaaaaattttcaggctcaagcaccctatcaagacaaaatagtgattagggcagatgtcaatatcattctcgttgatccgaaccttccatatcacgtgatgccgattgcatcccaaagttttatggacaacatttatgactttcaaaatttgtttatgggcttgcagctggattacatggatgtctctgccgccaacgtgatgaatacggttgacgtcctcaataaatctatccaaaaaaattattatgcaccatatggcttgcgtgattccaccttcgaagaagtaaaatctgctctggtaatgctcgcgggtttcattatatttgtcgtctggatcattgatcattggaacactccgcttggcggcggctatgtccgaagtgacgaagacaactacgactccggttatatggacggttattatattggcctccatgatcatgatgacgaccatcattgagaaccaagaccagctcaccaaatcaggcgggctggtcttttcgaacagtattgtatctcttaggggacgtatgctacgataatctaaacgaaaggactgacagacttgcccaagttaccgacctatcaaacagatcatcaaaccattacatttaacaattcaaatcgtcaaattcaattgactattatcaccccagagatcattcgggtctccgaaaatcgcggtgatcatggtgcctcatacgcgattgaaggcgacaaggaaaccacaacgacatacacagttaagcaacagcctgaccattatgaaatcacgaccgctgccttgaccatcaaggtggacgcggccatgcacatcgatgcctatgatgcccacggcaacccactggtcactgactaccgtggcagtcggactccgcttgatcgggggattgacgaggaacataaaaagttcgtccaagaagagggccacaacgttcccggtgccgacgatcaaaataatcccgactactttcaagttgtgaaggatttggcacctgatgaacagatctacgggctcggagacaagaccggttatctgaacaaacggggctatgagtatgatgactggaataccgataatccagcgccccacttggagaatttcaccagattgtacaaatcgattccagtgatgatcggcctcaaagctgggcatccctatggcctcttcttcgacaatccctaccggagccattttgattttggcaaagaaaatcccaactattatttctactcagctgaagccggcaacctcaattactacctaattggcggtaaaactctcaaagatatcgttaccaattatacctacttaaccggccgaacccctttgccgcaaaaatggacattgggataccaacaatcacgctggggttactctgccagccagaagatggtccaagatatcgtggattcgatgcacaaatacgatttaccatttgacgtgattcacttggacattgattatatgcgcggctaccgggtgttcacttggaatgacgaggcttatcaaggcaacccaaagaagtttgtaacggatttgaaagccaccggcacaaaaattgtcgccattatcgatcccggcgtcaagaaggatcccggctacaacatttatgatcaaggcatcaagaatgattatttcgtcaaggatccggcgggcaatgtctacgtcaaccaagtttggccggggaatgccgtcttcccagattttggccgccaagctgttcaaaaatggtggggcaaaaatgatcaatttctgactgatatgggggttgctgggatttggaacgacatgaacgaacccgcttcatttcaaggagaaattccccaagacattgttttcagcgatcacgaccagccgtcgactcataagaaaatgcataacgtctacggccacaacatggccaaggcgacctatgacggggtgaaacgcgcaaccgatagacgaccatttgtcattacccgggccgcttattcgggtacgcaaaaatattcaactgtctggaccggcgacaatcatagcatttggcctcacctacaactcctgattccccaactgtgtaatctgggaatcagtgggttcacttttgccggcaccgatattgccggctttggttcagacgcaacgccggaacttttgacccgctggattgaggcagccatcttcagtccgctgctgcgaaaccacagtgcgatgggaacccgtgcccaggaaccatgggccttcggtgaacccacgttatcaatttaccgtaaatttctaaagctgcgctaccgattcatcccttatctatacgacctatttgccaaagaatctaaaaatggtctgccactcatgcggccactggttttgaattatgaagatgacccacgagtccgaaacatcaacgatcaatatatggttggcgatgcaatcttagtcgcaccgatcgtccaaccatcgcagaccaaacgactggtttatctaccggctggaaaatggattgatttttggaaccaccgggaatatgagggccaacaagacattgtcgttgatgcaccgttagataagctcccgatgtttatcaagaaaggaaccattttgccttggggagccgaagtcgatcatatttctgaaacgcctgatccgacaatgacattcaacgtctatggggattcgggcagctatcatcactatcaggataacggcctagacttcaagtatcagcacggcgaattcaacgattatctcgtgaacgttgaccacggtcaggtcagcgttgaatttgttcaccatggttttcaaccttaccggaaaatcacggttaacctcaataatcagccagtcacgctaacgtacaattcaacaactgaacactatgaataacaaaggatctttgataaaccagttggcgctggcctatcaaagatcctttagtttgttattcattctcagtggaaaccgaatcatgtacagctttctggtttgcgaatttttccactcgtgccatgaaatccgcaaacaacgcgtcttgcttctcatcggtccgaaacattgcttctggatgccattgaacaccaatgatcaagtcgtcatcttggctttcaacgccctcaatcacgccatcctttgccaatgcggaaatattgagttggccagaaaccgccttaacggcctcgtggtggtggctattaaccaaagtcgagtcaccctggccgataatttttgccaaataggagtccggagtggtggagatggtgtgcgttccttgtggcatcggcgccttttggtaatgttggagggttggatgattccgttggctatacagatcttgataaagggtgccaccaagggcaacgtttagcacttggacgccccggcagatcccaaaaattggtttgcgtttggcaaccgccaatttgactaaggcgatttcgctggcgtccaagaaggcatctgtgtcgccgagattttgaaccggctcttcaccatagaacttcggcgcaacatccggtccacccggcagcagcaaaccgtcaatcaggtcaacgtagtgctccatgatttctggattgcgggtgggaatgagcactgggaccccaccgtgtttgatgacaccagcgacctcgtcatcgttgacggtatttcttgcaagattattaatgattcgagtctctgcgggaaatccaattacatattgtttatccaaatataccagctccttgatttatagaccgtcaatgaccttatcattgaggctcaaaataattgccttgagtaatttaacggtattttcgaagtcagaatatgccacaaatccatagttagtatgttcataacgaacaggaatcccaatacaaatggtgggtgccccttggaactcaagcaattcagaaccatcaattccaccaccagtccgaacagcacgggtaaatggaataccgttctggtgggcttgatctacagccaactgctgaaaatgcggattagcaataaaggaagtatccatatcacgcagcatcggcccacgctttaacccggtttggatcagccattctggcgtaaacgtgtcatcagctgggcatccctcaagacagattgcgatatctggatgaacctttttaacagtcactttcgcaccccgacagccgacttcttcctgggaagcaatcgcaccaaccaagttaacatccaagttttcctcagccaggtcagacattgccgtcatcaagcatgcagtaccaatccgattatcaaacgccttgcccatcatgacatcttgagttttgaagtactcccactcagtgtcaggtgcgatgggacaacccgtatcaatcttcaagacctctttggtctcttcagcgctgtttgttccaacgtcaatcactagattggcaatatcaattggttttttcttttctgcctctgtcatgaaatgcggtggcttggtggcaaccaaaccggtgatccattctccgtcttggtttcgaatccgcattttttctgcagttaaattagcgggtacccaaccaccgagcggaacaaatttaatggttccatttggcttgacggcttgaacaatcaaaccgacggcatccaagtgtgaatccagcatcaaagttttgcctttggaaggtgaattttgattatttttcaaatagacgttgttcatgtgatccgcgtgaaccgagctaaagctggaggctgtttgaacgacataatcctttacttcgtcctcaaagccacttggtccatttgcattggataaatgttcaattaaatttagtgctgacttcttatccaaaatattacccctttttcaaattatttggttaaataagctgttctgtagtcataatgtccattaattcgatcatagacaacccccttcaacttagggttaaccaggtcaatcccattggcttgataaatcggcgtaattccttgatcagtggccaaaatcttttcagcattgattaaatcttgccatctcttggtggcattattcgcatccttgttattggaatctttaatggcttgatcaaatgcttgactgctccacttgccattattttctgggttgtttgatgtaaattgggaaagaaatgaaattgggtcagcaaaatcagcggaccaacccgtaaagttaacttcaaagtttccagctgaagctcttgcaagcatcgaggcaaatggaatactgcttgattcaaccttgagacctggtaacgtttcttgaagctcactttgaataaactcaatgacatctttggtttgatcatcatcggccgacaagagcttgatagttaaattcttcttacccaattgtgataaggcctttttgtagtattgctttgccttagccgcatcatgatcaactgttccaggaacatacgcttctttggcaaaatcctcaccggttttaggattcttagcgaaatcggccggcacaaatcctttcgaaacaattgatccattttgcatcactttgttaattaattgacttcgattcaaagctaaagagaaagccaaccgtaagttacgattcttgaagacgcctttacgttggttgtattgcagatactctgttgcggctagtggccgtttaacagcatctttactcttcccaagttgtttggcttgttcaccaacaagactgattaaatcaagtttgccagattgaaacaggttatatgctgtgcttggcgatttggcaactgtgtaattgatctgagaaagtttgactgcttttttatcccaatactgattatttttaaccagcttccaggagtcattggttccagtccagccaacgtttttgaatgggccgttgtacacggtgtatttagcggatgtgccgtacttcttaccgtatttttcgacaactttttgatcaagcgggtaaagcgtctcacgcgccattaccattttgaagtaggtcgttggacgagcgagttgaacttttagttgatattttccatttgctttcacacctaacttattcggtgaaagtttaccgttcacaattgcatcggcatttttcacattatcaaaaaggtaagtgtattgactggccgttttaggattgaccgcccgttgccaagaatagacaaaatcttttgcggtcacaggatcgccattactccacttggcattgtgacgaatgttaatcgtgtatgtttttccatctttagaaatttttgtcttggttgccagcgcaggttccacatttccgtttgcatcataacgatacaagccttcaaaagtttcatcaatttgaataaatgacgttttatcatagatttttgacaaatccaagctggtaatctcagctgtcgtggataagctgatcttttgatttgatgccagcttagtcgacccttgatcggagctcttggagccacatgccgccagcaagactgttgttgctagaataccaagcgataataacgatcgtttaataacagaaatactcataatgtttccccgtttcctcattgaattttaatatactcaatcataaaccttttaaactttatgtcaatatatggtgatattatgcatgaatattcagtatgcaacgtggcgatgtgagaatatgaaaaagagccgcgttttttcgcgactccttcagctattattcttctatacatggtcatcaaatgctgatttaaaaccaattatcaattaattggggattcttctcaagtatctgcagtaaacggcgagcgggtttgcttggatgactttgaccggtttcccattttttgtaagtccgcaatgagacattcatgaacaatgccattttggtcttatcagctgaaacaagttttctaattcgaatgatatctgcgggtacataatcaggaatcgacaaaatgctggattcaaatttagccattttgatacctccaaagtgttagtgtgctaaccaatgtcttcatagtatcaaaaaataagcctatttaaaattattatcctttaaataatcccttacttgtgcctccccggaatacctaaacccaccaacaatcgcaaccccgtctccaacggccgccttcaacgaaccaagggtatcctcaaacggcgtcgacacgctagtcgaaaatggcaccacgcgattgccggagaaatcattttccataaacaaagtgttgaagatccgcggcacctgtccatcccaagtcggatagccaacaaaaatataatcgtattggtgtagatcgggtattgcagttttgatggcaacatctgctttgtctcgcatttgctgcataccaactttggagtacttgtcgtaaccagctggatatggtgtcttgggttccagtctgatgatgtctgaatgggtatatttttgaatggtttccgctgcggttttggttgtgcctgacagtgaaaaataaataatcaatgattttgtcatggtagcctctttctatttatataatgtttctaccctataccctggagtgcacttcatggcaaacaaaaaccgcggaatcacttccacggttcaaacttatttaattttagtaggcagtccaaccgccatctaccggcaagacagcaccatttacataacgagcctcatcggaaaccaggaacaaagcggtgtttgcgatttcggctgcagttccgggttcaggtgatgcacccatcccttgggattgacgctcataaccaaatttatcaacattcttgcccattgactcagcaatatttgtcttgatgccaccgggggcaatcgcattgactcgaatgccgtcattttggtacatgtaagccgtattcttggttaaaccaacaaccgcgtgttttgaggccgtgtatgcaactccggcacggccgccattcgttccaccaactgacgcaatgttcaaaatgacgccctgcttcttcggcaggaattccttgattgcttcacgagtcgagtacatgacgctgtcagtgttaacggcaaagactttcttccacatgtcatcagtcaaattgccaaccggcgccatattgtccatgatgccggcattattgacaacaatatcgagttgaccaaattcactttttgccaacttaaacattgcctgaatatcgtcttcgttggaaacatctgtcttgattgagactgctttgccgccatttttggtgatcgcagcaaccactttgtcaacccgatctttattcaaatcagcggcgacaacgctggcgccctcagcagtaaacaacttggccattgcagcccccatacctgatccggcaccggtgacaattgcgaccttattctttagacgatctgtcatgaaaaagcctcccttttattcataaaacgcttacaccattattgtatatgattgagcaagtggagtgaaagaaatgccccataacttacgctgattcgttgatatcgactttgacggtcttatcatcccagattgacggctgatattccaacttcaagtcggcatcccgttttgcctgaccaatcaggttaccggttacactcgcgccgggatccaggtcgccactgtttaacgtattgttagtatatttttcattcgtcacgacttccatcatgttggtggaattcccattagcatttaatttgaagtcaaatgaattatatggctgcttctcatcagtatcattcttaatggttacattacagatcacataccgattaccatccttgggcgtatcaaattcgttgccattatagaacgtcactttattgatcttgaatttataccctttatagttggccacttcaccgacattgtaattgcttttaagcgtcccatcgctattactggaagaactgtcctgagtcgctgtagtagttgactggttactggcagaatcgtcttcttcaccggaaactgcattgactgcaatcaccaatccaaaaacgaccaatacccaaacccaccatttcttataccatggcttggctggcttttgactattattgttcataattgacacctccaaaatattcgcgtataccattatgttttactaattgcaatcattagtataacgagtgatcgtgattaggtctattttggagtttgcattttgaaaaatgaacaatcattcatgtttgactttacccaagccaaattcaacctgccccaactgcaagtcgtcgagcctttgttggccccatttcaacatggcgtcaataatcggcatcaatgattttcccagcggggtaattgaatattgaaccttgaccggaacagtcttcagtggcttgcgattgaccaagccatcttcgactaattctttgagctttgccgtaatctcttttcttgaggctgcaggcaataatttttgaagctcatagaaataatagggtccatctgtcccaagatgatacaggatgttaattttccacttgccgctaatcatcgacaaagttaattccttgggacagttgaaaatgccgttcgctaatttttcttggactgcttctcttacgctatcagtcatttgaaccaactccttccatcagttacaaaaaagtgcggtattgcaggttgttcaacctagccacatgatgtagttagattaaatatatgaggaggataatcatgacaaaagtatttatcgctgatcaaattccaagtaaagctgttaagaaattataaagtgctggtctatccgttaccattcacgacagtgagcagggcttaatcactcacgaagagttggagaatgccgtgaaagatagtgattttctgattacaacattatccaccaaggtcgacgaatcaatcatcagcgcagcaaccaagttaaaattaattgccaactttggcgctggtttcaataatatcgacactaaagccgctagtacccaccacatcttggtgaccaacacaccggttgtttcaacaaattcggtggcagaagtgaccctcggcttaattctagccatcagccatcggattgtcgagggcgaccgtttgatgcacaaccaaggattttcgggatggtctccactattttttctaggccatgaactggcgggaaaaacattgggtgtgattggaatgggccacattggccgggatgttgccaagaaagcgcaagccttttcaatgaacgttcaatactggcagccagaacaatttagattaccacgagatgaggaaaatcgattaaacatccggtttgctgaattcaccgatctgcttcaaactagtgattttatcacggtccatgcaccactgaccgaagaaaatcaccatcaacttgacgccaaagccttcaagcaaatgaagtcatcggcgttcttaatcaacgccgcccgtggcccaattgttgacgaagcggctctggcatcggcactagagaaccatgagatcgccggtgcggctttggatgtctatgagcacgaaccaaccgttacccctggactgaagtcaatgaataacgtcatcttgacgccgcatatcggcaacgcaaccgttgaggcgcgtgattcaatggctgagatttgtgccaataacattttggactttttagctgggaaatcaattcaatcggttaattaaacaaacaatctgaattcctcccaatcaaaggggggattttttaatacatagttttggttaaaacagttgcatttacaactattggtggtagactataaatctaagtgaggaggtcatgttttgaaagatcgaaattcagtatcatcgctcattcatcaaattgccaagctggaagaaggcttgattaatcagcagttgcgcgaactcaatttaaatgtcgatcaagcccacacgctgcggtacattggcgatcacccggggacaaatcagcgggcaatcacaattattttaggacgcagcgctgccagtgtttccaatttgttaaaaggactggaaaccagaaacttgatcgagaaaaaattcaatccggataatgaccgcgaaaaacagctgaccctgactccaaacggcaaagagaccgtcacggcggtcaagggtgcgttcgacgtcctcgatgagaaagtcgatgcagctttacttgcaccggatgcgatttatgaccagctcactcaaatttatcaacaactaaaggagtaatcacatgtcactcacaccacaacaagaaatcgacaccaagcagcaaattaacgccaacttcaaactagcagaagtccccatcgaacaagtggctcaagatctggataccacgccggaacatgttcaagacattttggacttgaaccccacccggttggaggaaccttggattctcaaagcgtacctggatgagaaaatcattgaaaaaggcggcacaccggttccttatactgcattgctgggggacccgaagcattactggttcttgaacaaccgctttttgaagaagggtaagctgctaagctaaggaggcagacatcacatgaaagtcattacattagaagaacatttttcatcacaaaagttgggtcagaaaatggccgaggtcttaccaaaacgaccaatcggaaacgtcagtccgaagatgcaggattatatgcagcgctcactaccacccgaggcagaattggaagacgtcaccggcagtcggattcaatggatggatcaacaccagatttcaatgcaaatcctgtcatacggcaatcagaacccgcaaaattcagatccgaagtttgcggttgaactgacaaagttggcgaatgatgagctggcaaaagctgttgcgaaagcccccgatcgcttccgtgcctttgcatcgctcccggtttcccatcccactgacgctgcggcagaactgaaacgcggtgtcgaagagctcggcttcaagggggccatgctagtgagaccaacttctcaggctcatccattctttgatgatccattctacctacccatttttgaggcggcagccaacctcaatgtgccagtctatctgcatccctcattcccagattcacagattatcgactactattactctaacggtccgtgggatgacaaggtttccggtattttgggaactgcaggctatggttggcataccgatgtcggtatccagaccgtcagactactattaagtggcgttttcgaaaagtacccgaatctgaaattgatctccggtcactggggcgagtttgcctcgtttgcccttgagcgaatggatcaggtcatgtatccggaaaccaacctcagcgaacccatttcaaagatttatcgcgatcacgtgtatgtcaccccaagcggtattttgaccgaaccgcaattgaaattcgtgaaggacgaagtggggattgagcatttgctgtactcgattgattacccttatatcaaaccggaaaattctggcagtttcattgagagcagtcctctaacggatgaggagaaggaattgtttgcgcatgggaatgcggaaaagttactgcaactctgaatctgataacatcataacgataaaaaaaccagctggtattcccaaatagggttaccagctggttttgatttgcgcagtaatgggcggtcacttatgataagggctgccctcattaatcataaaagcccggtaaatctgctcagtcaacaccaacctcatcaattggtggggcaatgtgaaccggccaaaggaaatctgggtgtcggcacgatcgagaacgtgtttcgataacccaagtgatccgccaataacaaaggtgatgtccgaatgaccataggttgtcaggtcggcaatttccttcgcaaacgcttctgaagtccgctccttgcctaggatcgcgagtgcgtacacgtactcgcggtcctttattttgtccagaattcgcgcaccctctttgtccatcacttcatccatttctgcttggctgagtgactctggcgccttctcatcgggaacttccacaatctgaaacttgcaaaagcgcgataaccgcttcgcgtattccgcaatcccctgcttaaaatacttttcttttaattttccaacaacgaccaatttaatgttcactatgtaattgcctccaaatttatagttatcctgtgtaaaaaagcgggcttattaacaagttgtccacagagttatccacaggtttatgcaccttatcaacttttcagtgacccgcattattttaaaaattgtcaagggtcaaaaatgttatccacagaactgtggacaacgtgtgttcgcaatctgtcaccgcaaaccctattatatcagtcattatctcaacgaacaaatcccctttttatatcaaaaaaagttatccacaatttctgtggataacttttagtttttgggggataactattcaacgttattctatcagtggataacagaatcttgtggattgtccacagagttatccacagccaaaatgtggatagtttatcaaatctttacatccgatgaattttttaaataaaacttggttcgtcgttcgtatttataccatgtgtacggtacaagttccatatatttggtaaggccgttcgtaaacagtgaagcggtccaatgtttgcggacaaatcgaatcaatttaatcattatacctgaattgtcccaaacaaatccactttaaagattggagaatcaccattgacagtcaacttgattaatcacgatggggaatgggcgttgccgatccctggggatattagccctaaatatgagtcttatcacgtgtttcagacggaggagggtgttatcctctgtgttccacttagggctcttaaataagaagccatgtggctacagacacaaaagaacttcaatcccaacttgagaattgaagtcctctgatcaacttttgtgcttattcaccaaacaactctgcgagtgttttggctttcatattgttgctatcaagggtaatctgtttaccagccttgacttcatcatacttcagtaccacttgattgcctgtatcaccaatagttgcattcccctgcttgtcgaatagaggcttattagaatctagtctgttaccaatcgacgtatcaggattatcaggtttagcggtaaaggttaatttgaatacataaattgtcttaccactcataccgtctgcaaataacgttccattcgttccactgtagtcactagccgctaaatgagttccagctccccagaggaaaccgtcattctttgctgcgtagtaaattgtattcaatccctgatccttaacagcagcattgaggtttgcaaccgtaaccacatcgccggcataaccattgatattcgcgtctccagccaatgctttgctaaagtttgcgtcactatcacgtttaccgtttgcattttcaaagtatgcaagatcctgagttacgtccttggtatcagatttatcaaagaacagtgcactggaaaccaatgccttcgctggcagcttagcgacaaccaacttaacatcctgaccatatgcagccgctttaatggcagctaagttcgcagcaagttgatccttgctcaaaccatcagtggtgtagcccttaataccagccttggccaaaagagcagcataagccttcttcaaggtagcagcatcaggtgacgttgggtcagcaacactaacagtcttaatcgtgtccaaagccgttttgtcatttgtgcctttcgtcaaggttgttgaaccaacagccttaccggcctgatcaacaaacgacaattgaacttcattgtctttgattgggtcaacggcaacggtcttaatggaaacctggttaccgaatgtcgtttgagcaatttgagcttgttggtcagtggtcaatgtgttgttggcgcttaatgcaaaaccggtaccctttaacgcatcaactaacttagcttgaatagcagccgtatcggttgccgccaatttccaagttgagccatcctgcacacccaccggttgaccattggcagcgttagcagtcgtgtaatcaacataattaatcacgtttccgctcggatctgtcaaaacaatccgaactgccttgttaatcgttggtttcacaactgaaatcgtcacgctggatccaaaggttccctgggcaatggccgcgatctggccttgagtcaaggtgaatcccggataaccgagtggtgaaagtgcagaggcaatctgtgactgaattgaactggaatcattggaatccagcttccaagtgccattcacattggagccgactgttgcgcctttagttaccccagtcttcgtgaaatcaaccgaggtcaatgacgaacctgtcgccgaatcaactaacttaattcgaatcgcgttatcagcaattggtgaattgatgttggttgtcttcttcaatcctgaatacaaaatccagccatccgcgccggagttaccattattggtggcagaaatgtgaacccattggtcaccttcacgggttctcatcccagcttggtcaatttggtaactgacatttgcataaggtcttgaatcagttacctgacggccaaccttgtattgcgtccaagctggctgctcatatgtaactgtctgattattgtttgcggttcccgggtttgcgaattggaacgtcccgttgctcatatcatcagtgagcgagttctgttggaacgtcagataggatttcaccccgccagcaaagcttgaccgactcttaccaccataaatccaaccgcgatccttaccgtcaaaagtaaccaccttataatacacttttccccggttggttctggcaacccgataagcgcgaacgttcttgcttgatcgggttgatttggcaagatcccgtaacgtaatggtggttgcgaccttcttggctccttttagtgctgaagccttggtccacaatgccgctttaccggtaaaggtcacgttgcgcgaagctccggtacccctcaatttcacgttcgacgtaacccggacccgagattttgctgaaacagctgaagactgcgatatcccaactacagcaaagactcccagagcagccatggaaaccaggattgatcccttaatatgaattttcatgtcgatatcccctttgatcaatttgtgctacatcattattgtatctcaaatgtgaatttattaacattacatgaatgttaagtattacacttatgttaagtaagtaacgaccgacaattcattttaaggcaaaaaataacctccgcttatgagaaaacggaggttatcaatacttataattaaggattatttacttgcttcgcttaaaactttactggttgctttttcgttcaaagtaattgagccagtcttcttgtcacctttatgataataggtaactgagatcttatcgccaatcttgtgcttatacagaatatcacgcaattgactttgttgagtaatcttagtgccatccagctcggtaatcacatcgtatttggccaatccagcccgcttagcaggtgaattagcgttcacgttaagaacaaccgccccttgagtaacactcttaggcagcttcaaaatagagcgttgctgctgctcggaaatgttggatagatcggtgtagccgattcccagtgccggacggataacttggccgttcttgatcaactggttgataatcataaccacttcattacttgggatcgcaaagcccattccttcaacactggtaccctgctgatcagaagctaatttcatggaattgatcccgaccacttggccggcaaagttaatcaatggcccaccggagttcccggggttgatcgcagcatcagtttgaataaccgttgcgttaccaatttgttggccactctctgaagtttgcggtacttcccgtttcttagcggaaataattccctgagttactgaagttgcgtactgtgagcccagtggtgaaccgattgcgagaaccggttcggcaaccttgatgttatcagagtcgccaaaagttgcgactttcttgaccttgtcagagttaatcttgataacggccaaatcagaaacggcatccttaccgacaaccgaagcggaaaccttcgagccatcgctgagaataatctcgagggcattggcaccggcaaccacgtggttgttggtaacgatgtaagcagtattgccgctcttcttatagatcacaccggatccttcgcttgaggcttcaagttcgccgctgctcttctttttgctggaagaaccgccttgaatttgacccaaaattccagataaggtgtcgtcgcttgaactttgtttctgtaaattaataacggaaacaacagtgctcttagttgcgttaaacgctttttctgcctgagtattgagattaacttttacgttgctgaccttggtattgccattcttgttcgtaccagaaaccagctctgttccagttccattattattgttgttaaaataagaaactccgccgtaagtaatcccgccgccaagtgcgccagcgatcacagcggtcgcaatgaattttccaaatccgttattttgtgccaattagtgtgcccccttattattttatattacctataatatacttttttcatgacgaaagtgtgttttaaagtttagaaatatctaaaggatttttaaataatcattaaaggcgaagcgtggtcctgtgaggtatcgtacagcttaaagtcctcaccgacacccatatcgtggtcttccaagatggaagccaccgtcaagtgggcaagcgtcttcatgttattatgcaggctgcgatgacctaagaagacttttttagtccgatgaccgatgacatccaacatggtgttggcgccatcttcattggacaaatgtccttgatcacccaaaatccgctttttggtcatccaaggataatcgccattttccagcatttcaatatcatggttacattccaaaagataaccatcggcatctttgatgacgccttccatgcgatcagaaacataaccggtatcagttaggataacaaaagacttgttattatgatgaaaaacatagaattgtggctcagcagcgtcgtgggacaccgaaaagctttcaacatcaagatcgcccatatccatcacactgtcaggagcaatgatgttcttttgatcgtctgcgaccttaccaatccttggcgccatagcattccaggtgccttcattggcatacacctgaatcccatatttgcgtgccaagacaccggcacccagtcggtgatcggagtgctcatgggtcacaaaaagtgagtcgacgtcactgaggtctcgaccaatcgaattcatgagcgcttcaatcttcttgccgctcaatcccgcatcacacaaaactttgtggtccggcgtttcgatgtaagtcacgttaccgccactaccgctggcgaggacgctgattttcatatcatcattattcataaccgttcttcttcctaactttaattcattgatgtttgactattctttaaattctcatcagtttgtttgataatgccacccgtaaacgcgttgatccgtttcaactgaacttgggtagaattttgaggtctaattgcgataatccaagttggaataaagactcgatcgccatcgattgacaataacttggtgtacccgagacttgcccatgcaaccgtggtgttattcggaatctcattatactgatacaaccaaattaacgcccgggtttccgaaatggtttccgaactttcgcgcaggctcttgattccctgcagataagactgagtgtaactgacaatctgataattggaattcagcgtaaatctgatctgggcttcagaggagtaaatcgaacttcccatcgccttttgattgtaaacgatattccgactggttgaaaggtttttgctgtaaacatactggtcaccaaacaacacaaacgtggaatcggttaacaatttatcaattgatttgcgtggattattcttatcaaccgtgattggctgcttaagttcactttccagctcatgaccaacaaattggggagtctggttaaccaattgtcccatctggttacgcaaaacgtcgctttgttcaccagaaatgtaataggcagtttcgttcttcttggacaagttgccaactttaatctggtcgttacgcatttccttgacgatcactgaatccgagtcgccttgggacacgttgtcggcctgcatgtccatgttctttttgaacatcccaaacaagaaaatgtcgattgcgataaaggtcactaaaaagatgatctcaattcttcgaaagttcaccaggctccctcctttcctaatattggttcataagtgcagtgtaagagcgccattgatttttataatagatgtaccaatctggattcaggtcaatcaataatggagatgtagaatccttcttccaagtataacccagacggactttctgaagatcctttaaattgtacccacgattgaccagccgcttcagcattgtttcagttgacggcagcgaaacgtagcccttgttacttggcagcggcacctcaggattatccaatgaaaattggatccgctgagcactggagttcagtgtccgcgtcgagacggtcccaaagccactggctcgaaaaatcggaaaaccttcaacataggtccgatacatcaccgtccggctctttggatcatagctgaagaaacggacgttatccattggcagccctaacttagtgatgttcttgtaggaatcgttaatcgttgacgtcaaactgcggcggttatgatttggccgaaagtcagaaaattccgccatccggtttctggagttaaacgttaattgcagcgaactttgatcaccgtagatcgtcatattctttcgccgcttaacgttaatgctggttgaatcctgagtattcagcagtcggctaacatagtaatcgtcagattgacggtcaatcaaatacttataaggctgcatctgcacggagctggtaacgtatacgatcggccgattatttaataacttgaagctggccggttgcgtccgcatgtccatctgcagaaccttgttcaaagattttaaactgtgttttttaacatcgacttcatacacagtgaaatttttatcatagagaagatacagtttagttgaattgttggttggcaagacaactcggttaattttgatgttcggcagcttccggaatcgattgctgacaattgcgttaaatgtccgcatcgaaaccgtgtctgaatagttcagcataatcgaatcagtctggttagcgattcgaaaatagtcaacttgcgaatttttgcttaaagttttcatccgcggattttgataatgatgcatcgttttcttaatctcagtcacggtgttcactaacttgttgaccataatctgttgggtcccgtccgcattcgtatgaattgcctgaaccggtgagtagacgtaccgtttgggcttaatcatctgctgcgtctgcgggctttgcgccgtttgcttattggtccgataattagccggattggtccagagaaccaccgagagcgttagactggcaaccaccgcaatggtgagtgcaaggggtattaagtatttactaaacctcatcccacaagtcctcctcttctaccggttcgtatggcaaagcaatatagaatgttgatcccttgccttccacactctcggcccaaatttggccatgcaaggcctcgacagtttccttggaaatcgccaagcccaatccgctaccgccttgctgacgggaacgggccttatcaactctatagaaccggtcaaagatatgcggaatatcctttcgcggaattcccaatccttgatcgctgacacttaagatgaccttatttctggtttcatagagccggcacgtaatcacgccgccatccggtgaatatttgatggcgttattcatcaaattatccaatacttgggtaaagcggtcggtgtccaggtcaacccacagatcccgcttggtaaagtagcgtttgatcgtataggtcttttctggatgatcttcttttttaagaatcatgtcaaatcggttcaaaacataattgaacaattcattgatattgaccaattccacttccatcttctgcgtcccggaatccatccgtgacaatgttaacaggtcgttaatcatacgaatcattcgatcggtttcatcttgagtgactttcaagaacttcggtgccagcttcggatccttccaggcaccatcagacagcgcttcaatgtatgaacgaacactggtcaatggggttcgcaattcatgagaaacgttggacacgaactgtttacgatcttgatcgattcgctgctgctcggtgatatcacgaagcacgcagaccagcccgctaatgaagccggattcccgttgaatcagtgaaaaatgggcgtgcaaaaccagactgtgatcttcacttgaaaaatcaaggattaactcatccggtttttcaagcaagtcccgcagactgtagtctttgcgaatatccaacacgtccaaaatcgacttgcccatggcttggttttcatcaagatccaagaaactggcggccgtttcattaatgataatcacgtttccacgccgatcggtcgccaaaacaccatcggtcatatttgccaggaccgaatccaagcgtcgccgttcagactcagttgactcatgggactcttcaaccctgacagataggttgttaaccgcactggcaagttgacccagctcatcatttccataaacgtgaacttggccggaatagtccccacgggcaattctgatggtctgcttcttcatttctccaatcggtcgtgtaattgctcgcgaaataacaatcgagattaataaccccaaaataatggcaatcgacgcggcgaacagataaatcagcgtaatgctgttaatactgtcatagacgctgtcgaggttcgcccgggtgtataccaccccgacgaccgtactattattgttggagctcttaatcaacggtgaaatcatggtgtaataacgcgcaccagttgaagaatcataggttgtcttttcaaattttttcccgttgtaaattgcgttcttgacgttatcatcggtggtcttttggccaacgatcgcctggttgttaatctgattggtaccgcgaattgtccctttattatcaatgacttgaatttgcgcggtattgccgctgtcggaatcattcaagatggtcttgatccggccgttggcttttgtttcatcggcacttgacaattgggtcgtcaatgaattggtgacataagtctgcagttgaatttggttcttaaaggtcgccaaattttgatgctccagctgcctaacaaagaccgcaccaacgatttccagcgttaccaggaggatcagggcgaaaaccagtgcgatcttaaatttgattgattggtaaaatttaattcgattattcacaaccagttaataccccttatgcattgatttcattgagattatgcttgatcactttctgggttgcgcaggtaataacctaccccacgacgggttaccagccaggttggatgactggggctgtcctcaactttttcacggagacgccggacagtgacatcaacggttctcacgtcaccaaaataatcatagccccaaacggtctgcagtaaatgctcccgggtcatgacttggccaatgtgttgggccaaataatgcaacaattcaaattcacggtgggtcaattcaatattttcaccccgtttggaaactgagtaagcttccggatgaatcaccaaatcaccgatcttgatatctttattttcgtcttcttcgttattggaactgctattggtcccctgacggcgtaggttagccttcacacgggcgactaattctcggttcgagaatggcttggtcacataatcatcagccccaagctccaagccaagaaccttatccaactcggaatctttggcagtcaccataatgattggggtgtccttagtcttacggacttccctggcaacttccaggccatcaactttgggtaacatcagatccaagataattaaatccggatcaacgtctttgacttgctgcaatgcttcttcaccatcataagctactgagacttcgtagccttctttagttaaattaaatttttcaatgtcgacgattggtttttcgtcatcgacaaccagtatcttttttgccattaacaatttctcctaacatggattttaatattgttattttctaaaatttgcacacgccaacatgttgctattataacacagaccgatattggtcaaataaatccccttttccgtgttgcaaatattttgagcatatgctattatatttaagtcggttagtaatgggcagttagctcagttggtagagcaacggactcttaatccgtgggtccagggttcgagcccctgactgcccatcaattacataccattaaataacgatcacgcagctactcatagccgtggttgttatttttttgcctaaaaatagctgtccactgcatcccttcataggatgatggacagctatttgacgttatgatatgttagtccattcgtcaaaaagacggtcatatacttaatttcatcttcaatgttcaccggaatgccgagaattcgtttgccaaaatagccaatgacagacgaaaacaggaattgaataacataacgctccgggaaccgggccattttgccggtcttttgcagatgtttgatatttggtatcacgttggatgatatgtgactgctaaaggcctctgtaagctgtgaaataatcccctcatcttcaacaatcacctgtccggcaagtaacttcaaggcagcgtagttctggtcgataaatctcagccgatcaggaacgattgctctgacaaagggctcgacctcatcgtaagacttgctgaaagccgtattgccaaactcgtcaacggctttaggcaatacatcgtttaatagtggggccagcaccgccaccaataaagcctgtttattgtggaaacgctgatagaccgaaccgacagccacgcctgcccgatcagcaatttgggcacttgaggtttcactaaagccttgagtagaaaacagttcgagggccgcctggaggatccgcttctgtttatctgtcagaccgtccatttttttgagtgtctctttatataattgttgaaaatcattctctgcatcagccacagctcgcacctcatttcgtttttagtttagcggacttggaatgacttttcaaatgtgtttgacatttgtttagaaaaagattattgttgctaagttacaaaaatgaatgagcattcattcgttattttaaggaggaacaactaaaatgtcaaaatggttttcaaataaatttagttggctgggaatgttagtcgccagttttattgcagtttcgtttgtattctgcattctaccggctttcaagcacatgccaaccaatactcaaaacttaccaatcgtcattgtcaatcaagataaccaacagatctcggataaggttgccgacggtttgaaggacaacctgcccttcaagcatatttcgacttcgagtagcctaagccgaaccaaacaccgaatcgaacttcgtaaagcttcgctggcggttgtgattcccgatggatttaataaggacgttcgtgccggcaaacgaccaaccgttaattttgtcgtcaataacgctaatagcatggtccaaaccaacgttaatcagggactgatctcccggatccaaagtacagttaacgcccagttgacccagcagtcgcttgtcggcatgtatgccaaacaacttgcgcctaagatgatgaaaactgcaatggcagctggaatgaagaccgccatgcaaaaagctatgacggcctcaaaaggtcaagctgttaatcaaaaacagatccaaaaacaggttcaagcaaaagtacaactcaagatccaaaagcaagtcatggcccgggccactaagatggcagcaccatttaacattacggctaaatcatcgaccgataccatgggtaccaagcaggtcaatatgcagcaccagatggcaccgatgtttatctcgatgggccaatatctgggcctgatgatcgcttcaatcatcatcacgatgaccttcatgtcggttcgtttcatcgccggcaagtggaaaaccttccttggccttcaagtcacgggcgttattaccgcggttgttttagcattattgaccgttggtgcgctgcgatgcctcgtcagctttgacggtggggttttcaacgctttgctttggcaaaatgtcttgtacgattttgcagccttcgaacttaccagcggcttggcacttctatttggcggcctaccaagtttgctgattcaattaccactgttcgtccttcaaatcatggctggtggcggaacgctcccacgggcggccatgaccagtttctacaagttcttaagccaaacgacgccaatgtaccaaaacatctacagcagttataacatcatggctaacctcggcaacacaggtgccttccagcagaccctctggtgggttgcacttggtggcctggtaatcgggtcactggcagtctggattggttatcgcggcaaagaacgacgcggtttggcagctgttattccgaccaagttttaaaaaataatgaatatcccaaagacggcttccctcaaaggagccgtctttttgcattggagaaacgatttacaaaccacaaacactattgacgcatttaacatttgcaggaacgaatcgtcattgcagctcatttatgacccgaatcgcttttcccaaaatttgattattagtgtctgtagtgaggatgattggcttagaattccatggcgggagtgacacaccacatacggtctatagttttgataagtcggtttttgactaatatctgactaatactaaagggactcagatttttccgagtccctttagtatacataaaccacatttttaattttctttttcccctaaaacaacattataaatcaaataaaatgatggtgatcccccaggatggataagcgtatcacttttgtgattatcttgatcccccacctcatcataaatacaaattcctagttgatagtttcccatattggctctcttctcagcagtgtatcccgccgcatcaagcattttggcaactgcatttactcgacccgtagcaggtaataaatatgtcgaattcaaaaacgatgaaggatcagacccaagaaaataatggtttttgtaatttgtatatttactacccttatacgtcagataattggcattaaaatccaatttattggtaaatccattaagtgggattaatcctgttttagcaattggattattgttagcaacttgctttgacaaatccaaactaacctgactattcgggaatagcttcaaaatctgtctagcaagtttttgagatggtgccgtctttaaatagttaatgtattctgcatcgctagtaaatgaattaacgttcttagctaaagccctggttacatatttatgatagacaagcccccgaactgattgatcagcgttactaatcttataatagatgccctttccatgcttagttgtaacggaaacagcactatacaaattccattcggtgtacctatagttgtttagtttatgaattcgcttggtatgcttaaagttccacatgtaaccagtttgctgatccttctgaattgttggggccgtatacatatgcgttgtatccaatcgatcatcatgattatcccaataaactttaattttactttttgcctggctggtgtttgaaatgccaaggatgagtagaaaagtcactaccaaaattccaatcttaagccgttttgtcattaaagaccctccaatttaaacaaattcacaattgtcctcaagtctgattatacttgatcatcgaaattcttgccaaatatctgacatagaagaatcttacaaataacgatattaaaatacggccaatggaaaatttcccaaaggccgcttagaatgatattttggataaaatctattactgctgagcataggaaatcgatgaaaacttattatacgacttcacgaacagtaatttaaccgttccacgagggccagatcggttcttctcaataatgacctcaacttctccgacattattttcgtcgtcttcaccctcggagccggaatcatcactatcatcgtcttcatcacgataataatcatcacggtaaagaaaggcgacgatatcggcatcctgctcgattgaacctgattcacggatatcagataagacgggccgcttatcctggcgttgctcaactccacgagaaagctgagatagcgcaatcacggggacatggagttccttggccaatttcttcaattgacgggaaatgccggaaacttcctgttgccggttttcggcgttactgccttcaatcagctgcagataatcgacaaccactaagcccaagttaccggtttccttcgccagccgtcgacatttagcgcggatttcagacatcttgatccccgccgtatcgtccatataaatgttggcccgagacaaactgcccatggcaactaccagattctgccactcatcttcagttagttgaccggtccgcaaatggttggcatcaatactaccttcggcacacagcatccggttaaccagcgattcggcactcatttccaaactgaaaatagcgacagttttatccgttttggtcccgacattttgggccagattcaaggcaaaggccgttttaccaacggccggtcgggcagctaaaatgatcagctcatcgctatgcaaacctgttgtgatcttgtcgagttccggataaccggttgaaagaccggtaaccgcatccccttcttgggacaagcggtcaatttcgttaaaggcgttatttaagacttctttgatcggtttaaaaccagactgagtccgattttcagccacattcataatatctcgttcagcgtcatccaagaccgtggtgacatcgtcatcggtattatagctgttagtaacgatgttggtggcagtttggatcagccggcgcaaaatggccttatccttgacgatttttgcgtagtaagccacgttggcagccgttgggacagaaccagccagatcggcgatgtattccatgccgccaacgtcgtccaagttattttgttcagttaaaatgttggtgattgtcaccacatcaattgcttcatcgcggtcgtttaaagtgaccatatcctgatagataatttggtgagcatgcttataaaagtcatcaggctctaagaactccatggactcaaccaaagcatcggtactcaagaaaatcgatccgaggacggccttttccgcgtcgatattttgtggtggtaattcgtttacaaactcattgctcatgtttattcctcaaattcgttcacgttaaatacaatagttaaattgtagcacactccccttaaatctggtcagattggagaagaaaagagactcgcccacaaggtggtccttttgtgaggagtctctgttacatttacctggataaaggttgttcgcgctctatttttcagaaacatgtacccggatcttagcagtcacatcaacatgcaacttaaccgggacgttggtgtagccggcaactttaattggttccggtaattcaatcttgcgtttatcaagcttgacaccatactgtttttccagtgctgtggcaatttgcttgcttgggattgaaccaaagaggcggccgtccgttccagctttggcctttaattcaacgactgtcttgtcgtcttcaagcttggcctttaactgcttggattcctccaactcttcttcctcacgcttttcttcggccttttgttggccctttaactggctcattgccgctttagtggctgcctttgccttcccattcttaatcagaaagttttgagcatagccgtcaggaacttctttaacttccccgcgcttacctttaccacggacgtcttgcagaaaaataactttcataacagatcactcctactatcctcaaaaatttaaatacctttattcattatcatcgatattcttgatcgtttcaagcaacatttttttcacatcggcaaccgacttgtcggaaacctgggtggcaccactggataagtggccaccgccgcccatttgctccataatgacttgaacgttaacggcaccggtacttcgagcagaaacgccaatttggccgtcggagcgcttagtgatgatgaatgatgcgtcaaccccagacattgtcagtaacgagtcacaggcttgtgccgccgtgaccggatcataaacctggtcttcttcgccaacaatcaaagccatattcttgtggaagaattcaactttggaaattagatggttgcgttgcaggtaactatcaatattttccttcataaattgctgcatttcatcagaatcggctcccgcagaacgcaagtaactggcagcatcaaaggttctggtaccggttcgcattgagaagcgctgagtatcaataaagatcccggttagcattgcggttgcttcaatccggttgattggttcttcttcgtgcggctgatattcaaacatttccgtgatcagctcacaagtggatgatgcgtaaggttcgatgtataccagcattgggttttcagggaactcttcaccccggcgatggtggtcaataatgaccacttttgctgacattcgcttgtataagtcttctgaaatgctgattgaaggcttggaatgatcaaccataatcagcatgctgctgtcagttgctttggcaatcgcctctgaaggggtaatgattgaatcggcaatttctgggtacttcttggttgcttccaataatcgttgaatatctgagtggaccttctccttatcaaggacgatccagcatttcttattattcatttgggcaattcgtctgatccccagacaagcacccaaggagtccatgtccggtctggtgtggccttggacaaagacctgatctgaggcactcatcaattcgttcaaagcttgagaaatcatccgtgcccgaacccgggtccgcttctccattgggttggtcttgccgccatagaaccgcgcggtaccatccaatgacttaacaacgacctggtcaccgccacgacctaacgctaaatcaaggttgctttgagcttggtcggccaaattattcaggtcatcttcgccgtaagcaatcccgatactcaacgtcagtgggaagttttgcttggaagtcgtctctcggacagtgtccaagatattgaacttgtcattctcaatcgccgtcaacgactttgagtaggccagcaggaagaagtggtcatcatcgatttgcttgagatacatcccatatttttgggaccaggttgccaattcgttggtcacatagttgcttaaattagagatttcctggtcagtcattgactgggtaatttcgtcgtagttatccaagaaaatttgaccaacggagatctgctcttcgttgtatcgttcctccaggttggcataccgggtaatattcatcaaatagaccgagttatattccttttggatcagcatggtaaacttatggtcccgccaagtgatcgtgtggaattcatctgattcagcgtacttggtgattaactgctggaggtcatgatcgatgtcgtcgatctttcgacccaacaaattctcatccttaaaatacttcaccatataggggttcgcccactccacctgttcgtcgtcatttaagatcatgacgccgatcggcatttcgagcagcgactcctgttccccacgatgaattcggtatgataggtcggtaatatagcggttggtatcggaactgatttcgttcatcatgacgatggtaaaaatcaagccgacaacactgatcacaatgagaatgagggaagccacgatattatataaaaatgaaataacgatgccgtagatcacgattaatgaaatgaacatcatgatccttctgaggcgtcggttatgaacaaatggtggcagttcaccacggttgtttgtgaaccaatttttcatgttaattcctcttcataatagcttaatgctcttattttaccataaatcggcctgctttattatttctggtgggttctcatctcaatgatgaagcaaagaaaaattcccagcatcactgtcgggaatttttcagagtcattatatgatatttattggaagagacatgcaaattcatttcattgaattgttagacaattactggtcggtgtctggaaccaatcgtctttgatggatataagttgcggcaccgaaaacaaccgtccagacaattgcaccaacagcaccaataatgtcttctggaacaaagaacagtgaaccaaagataaccacaaaaaatgcgattgtcagcggactcatgatcttgtatgccggcatcaagaagccatttggcaggaagtcagctgattgacggtactttctgtgagccagcattgccaaggtgtacacaatgatgtacatatcactggaaattccagttacgatggtaaatacggatgccaaactgttagtcaaactgatcagtggcgtaatcaagaccagtgctgccgagaagataattgcccgggcaggaacaccattgttggaaattttagcaaacgtttttcgcatccagctgtcttccggaacttctgttgccaactgatagaaatgtcggccggctgagaagatacaactgtttaaggatgatgcggcggaagttaaaacaacaaagttaatcacggcggccgctgctggtaatccggcgagtttcaatacttgaacaaagggactgctgtcaggggtaatggatgaccatgggatgatccccataatcacagtcaaggccccaatatagaagattaagatccgaatcaaagtttcattaacggcctttttgataaccgtttgcggatttttggcttcaccaattgtgatactaacgaattcaattcccatgaatgcgaagaagaccattgggaacgcagcgataaaactcacaccgccatgggggaacagttgaaaattgtggaaaatattgccaattgtggcatggccaagtggcgtcaccgaatggctgaacatcataaagattccagtaaagattaatgccagaatggcaacgattttgatcattgcaaaccagaattcagcttctccaaacaaccgtgcagcaattaaattaattccagctaaaactcccaagaaaataacttcaataatccaagccggaacctgggggaaccagaatttaacatacgttgctgtggcactaatttcacccatacaaacgaataccaacccaatccagtatgtccagccggtaaaatgaccaactgttggacccagataacgggaaataaatgaaacgaatgtatgttgcgacggatcggaatagaacatttcaccaattccacgcatcatgaaaaagaaaaacaggccaagtaccaaatagatcagcatgactgagggacccgtcttactgatggtgctcccagagcccaggaacaacccggtaccaatcgttccaccaatcgcgatcatctgaacgtgacgattacttaacgcacgcatggttccatcttggttctcttgaatttttgacttcataggcatcctcctaaataagagcaacataagaattagattaaaaagttctaatgagaatgcatttatattatcacaaatgggcatttgatgttaggtttggttacattttgttatttaaaaaggtgaaaataagaattttttcgataatcttaggcgaatggggaagaattgctaagattatttaacgacaatgtgcatttgggggattatgagcttcgtcattcccagcaatcgatcatggaaacatttcttgcaattcctctcatcaagttttatactctctttaataattaaagtcgaattacatgaagtagtgccttatctgggtgtcaggaagttggtggttgctgcgaaccaatcagggtaaggtggcgaaataccgtaatatcacgacaatggtcaataactagaatccattatcttctagtgagcggtgtatttttgatacacaagttgggtggtaccacggttaaaatcgtccctattgcatttatttgcagtagggacgattttttattgacttaagggggattttctatgagaagagcaacgaatggcggtttaccacgatatttgagtcaactgaatttaaagtagccaaaaatttgaaaataaaaagaggttggcaatatgagaaatagtagagtgagtttgcgtgaagcgattttagtattagttgttgcattagccattatgggaaccggggtaatcggtttgggattgtctccacaagttccagtattattagcaattaccgtcacaatcttttgggcaaaagtgactgggtttagttgggatgagatcaatgccgggattaaggatgggattgataaaggcatcatccccattgtcatctttatcttaatcggtgcgatgatcagtacctggatcgccgctggaacaattccaacgttgatggtcatcggcttcaaagccatcagtgcccaatggttcttaccaaccgtctttctggtctgttcactggttggtgccgccgttggtagttgtttcacggttgtctcaactgtcgggattgctttcttcggcatcggtgtcaccatgaacttcaatccggccctggtcgctggtgcgattatttccggcggggtcttcggtgataaatgttcaccactttccgaaaccaacaacttggcagcagccgtggtcgacaccgacttatttgatcacatgaaaaccatcctttggtcgacgattccagctgccacgatttccaccattgcctttgctcttcttggaatgggtcacaaccatgccgatatgaacaagatcaatacaacggttgccgcattgaacaacgattttcacatttcaattgtcgccttgattccgatcatcttggtgtttgtctgcgccggctttaaaatggcagctattccaaccatgctactgaacatctttgtttcagcggggatgatgtttgtcaacaaccctggattaaacgtcaccaaagccagcacgatcatcaccaatggctttatcgcaaagacttctaacagtgaggtcaacttattactttcacggggcggcatcgtcagcatgatgccgacagttgccctaattgttctgacattatcgcttggtggtctattagtccattttggccttatcagcgcgattatgtcaccactggctaccagattgaataatccggccaaactagttacagcggcactgggagcctgcattggggtgaatatcttcgttggtgaacaatttctttcgattatcttacctggacgagccttcaaaaagacgttcaataacggtggcctggccagccgagcccttgggcgggttcttgaagatggcggtaccgttttaaactacttggttccatggggcgttggcggcgtcttcattgccaacacattgagtgtcccaactatccaatacctgccatttgtattcttcagtctgctttgcccagtcttctcactattgagtggattcaccggggtcggtttaaagaaattaggacctgatcaacaagttgacaacgccaagcccgttactaacgaaaactaattgatgtcgatacaagccttcccggttcagtttctgggaaggcttgtcttatgagcaaataaaaaagccatccccgaaaggatgacttcgataaatcattattagtcggccgcaacgaaaggcatcaagcccatgatacgtgcacgtttaatagcaattgttaaagcacgttggttctttgcgctggttccagtaacacgacgtggaagaatctttccacgttctgaaacaaatcgcttcaataaatcgatatctttgtagtcgatgtattcaatgtgatttgcagcaataaaatcaactttacgacgacgacgaccgccgccacgtctttgatatgccatagtttttcctcctcgaaaatttactttaccaattcattagaatggtaaatcatcatcggaaatgtcaatcgagtccccagagttagcgaacggatcattgggattattgttcccgttattaccgttatttccaccattgttagtcggattattcccgccgttattgttggaattgccactatttccggtaccggcatttgaatgattatcaaatggattggcattaccgttattttgttgaggagcattgccattttgctgaccatttgagttgttccttgcagaacggggctcaagcagcgcaaaattctctactacaacttcggtcacataaacacgttgtccctgtgcgttttcgtaatttctggtctgaatacggccatcaattccaacaagcgaccccttatgaacgaagttggcaaagttttcagcggatttacgccagattacgcagttaatgaaatcagcctctcgttccccctgttgattggtaaattgccgatcaacggcaagtgagaacgaaccgacagcggttccgctttgagtgtatcgtaaatcaacatcgcgggttaggcgacccgtaagaactgcacgattaagcatgctgaatttgctcctctcatattagaatcaattattagtcgtcacgaacaacgatcatatgacgtaagatatcgccattgatttttgaaagacgatcaaattcgttaagtgatgcgtctgaatcagttgttaaagttacaacgtgataggttccttcgttgaagccaccgatttcgtaagcaaaacgacgctttgaccagtcttttgaacttagtaccttagcaccattgtcagtcaagatcttgtcgaatcgttcgatcaatgcagattttgcagattcttcaatatcaggacggatgatgtaagtaatttcgtatttcttttcttccatgatttgcacctccttatggacttatggccctcttcccgagagcaaggagagtttctgtttttacccagatactcacaatataaaataataccacgtgtggacctaaatatcaattgcctaattgtgattcacgatacacttattatatacgatagaaaccacctggattattcttttggagaaaataattcacgatcaggaattaaataattccttaataattaggaaccccttgctacacttgggttcccccagtaaatcacctacggcagtcaagcagatacttgactcttttgattttggaagtaaactagtatcaattccaaattcaatttggagtttggaaacgctttttcgcacgtgtcccatgatttaacaaaaataaagaaacgaggaattcaatgacacttttactattaatcatcgttggggtttcagcattttactacttcagaagttctcaaacaaatacccgctcgagtcgatatcaaaacggccaggatcctcatgcatacgcttatgcacgtagcgagcacccagaaattctggataaaggccaaacaaccggccgaccacgtaaaaatattaattaacctaaaatctgattcaaaaacagcgtccctcaataatgaggaacgctgttttattacatatttttggggaaaagaacacggggaatgttctaatactgtgcagcactcatgggtatcctctaatattatttcccatcatgagaacagaagcaaatgcctaaaaatttctgttagaggatacggatgataggacgttgcacacaaattaatagttgatacttagaagatgggtcttcttaacatcggcaatggtcttggttccggccaattgcatcgttgtcttcaattcatcaccgagatgttcaaagactgcttgaacaccttcagcgccacctaaagccaaaccatagataaccggtcgacccatggctaccaagtctgcacctgaagcaagtgccttgaatgcatcagatccacggcgaacaccggaatcaaagatgatcggaacacggccattaacagctttggcaacatcttccaaaacatcgaatgatgctggtccaccgtttaattgacggccaccatggttggatacgtaaacaccggcagccccggcaccgattgcgtaaagggcatcttctggtgattcaattcctttaacaatcactggcaaatcagtgtagtcagcgatcttcttaacgtcgtcgggcccaatcttttgagcagccgcagcataaatttcagcaattcccttgcctttagcgtcgccttcactaaatttagtcaagtttgccattggaattgggaattggaagttattcttgatgtcgtcttcacgataaccatcaacggtggcatcaacagtcaagataatgcctttgacgccagcctttttagcttcgtcaagcaacgagtagttgaagtcccaatctttactcatataaagttggaagaattggggtgcaccgttcccagctgcagcagtatctgagatggacactgacgagtaagtactttgggccatcaaaccaccaacggcagcgacaccttttgcagtatccttttcaccttgtgagtgggccaatccctgagcggcagttggtgccatcataattggcgtttttagcggaattccaaagacgttagtgtcgagtgatggattttcaatattactcaacgcacgcggaacgatttgcttgtgggtaaatgctttacggttggcttttaaagtccagttgttttctgaaccaccgacgatgtatccaaaaccgccagttggaatgatttgcttagctcgttcttccaactcttccaagtttaaaatattaattttttcttcgttatcgttttgtttgtaaccattaacaacagtcatgaataaattacctccaggtagtcgtattttaattcttacaaaaagcatatcacttacgaaaagtaagtcaaagaattagctcgacttttttatcccattttcttaggagaattcatgcttatgtttcacgtgaaacaaaaagtcggtgagaattaaatctcatcgactttgtaattagctgaatattaattatctgaatctgagttttgatccgcattggtaccggaatcatcacttgcttgttctgaatcagatgactgatcttttgtgtcatcctctgaatcatcctgcttctcaaccttagccatggttgcaactttagcgccatcggtcattctgatcaagtgaacaccgagagttgcccgccccgtttgagaaacgtcctcaacactgaatcgaatcatgacaccctgatctgtgatcagcatgatgtcttcctcaccgttaaccgttgtcaaaccggcaagcggcccattcttttcagtgatgttggcagtcttaattcctttaccgccccgacccttaattgggtattcagcagctggggtgcgtttaccatagccattttcagaaatgataaagacctcactgtcaggtttcaagatatcagaaccgaccacataatcgttctcacgtagtctaacaccccggacaccagtagctgatcgtcccattgaacgaacatcggcagcattgaaactaactgcgtagccacggtgagttccaatgataatattttgatcctcactagcaatcagaacgttgctaacctgatcatcatccttgaggttaatggctttcagaccattactacggatgttggcaaagtcagacactggggtgcgcttaacggttcccatcaaagtgacaaagaaaagatccttttcaatatcgttattcttatcggagacgttaatcacagcctgaattttttcgttattgccaatgttcaacaggttaatcactggaatacccttagcagaacggccgtattcgggaatttcataacccttcatccgataaactttaccggcatcggtgaagaacaacagcacatcgtgggttgaagttgaaactaagtgttctacgaaatcatcgttgtgaacacccattccttgaacaccacgaccaccacgattttgggctttaaactcagaagttggtaaccgtttgatgtatccgttatgcgttagagaaatgatcacgtcttcttcttcgatcaggtcctcatcttcaagactcagaacttcacccaccaagagttcagtccgtcgtggatcgccaaatttgttttggatctccaataattcttgataaatgatttcattgacccgttcacgactggcaagaatcgctttgtattcttcaatgtccttcatcaattgattgtattctttatcaatcttttcgcgttccaaaccggttaaccgaaccagacgcatgtccaagatcgcttgagcctgcttgtcatccagaccaaagccttcgattaattggttcttggcaacgtcaccggtctgtgaaccacggataattttgataatttcatcaatgtggtcaagggcaatccttaacccttcgaggatgtgagccctggcctgagccttgttcagctcatacttggtccgtcgttgaataacttcaacttggtgctccagataatagttcaaaatttctttcaaactcaaaatctttggcgtgcctttgacaattgccaacatgttgaaactaaatgaagtctgcatcagggttaatttgtacaaattgttcaagatgacttcggcacttgcatcccgacgaacatcaatcacaacccgcattccttcacggtcagactcatcattaatatccgtgatgccttcaatccgcttatcgcgggctaattcagcaatccgttcaattaacttggccttgttgaccatgtaaggtaattcggtggcaatgattcgctgtttgccgccggcttccccttcaatttcaactttggcgcggacaataatggttcccttaccggtttcataggctttccgaataccggatttacccatgacaacgccgccggttggaaaatcaggtcctggcaaagcctccatcagatctgctgtcgtggcatcggggttcttcatcaaaacatgaatggcactgatgacttcggacaaattgtgaggtggaatattggttgccatccctacggcaattcctgacgcaccgttgactaacaggttcgggaatcgtgacggcaaaacgcttggttcacgttcagtcccatcatagttgggctggaaatcgatggtatctttgttgatatcacgcagcatttccatcgcaatcttgcttaaccgggcttcggtataacgcatcgctgcagcgccatcaccatcaactgaaccaaagtttccgtgaccatcaactaacatgtaacggtagctaaagtcctgagccattcgaaccattgactcatacacggcggtatcgccatggggatggtacttacctaaaacatcgccgacaattctggctgatttcttataaggcttatcgggtgtcacacccaattcatgcatatcatacaaaatacgacgatgaaccggctttaaaccatcacgaacatcgggcagcgcacgggcaacaatgacactcatggcgtagtcaagaaatgacgttcgcatttttttagatagatcaacgttggtcactcgaccagcaattggttcatcatggttatctttattcgccaaattatttacctccattcatgggtttcggtggcatgtttcatgtgaaacattttctgcttagttattaagcagctttaaacatcaagattttccacaaacgttgcgttatcttcaataaactcgcgtcgtggttccaccttgtcgcccattaacatcgagaagaccttatctgcttcggccgcatcggaggattcaactctcaacagatgacggttttcgggattcattgtggtgtcccacaattgttcagcatccatttctcctaaacctttgtatcgttgaatcacgggttttggtgatggctgcagggttcctaagaatgcattcaaatcatcatcggaatcaatgtaacgtgacatcttcccttgacggacttgatacaacggtggctgggcaacgtagacaaaaccggcatcaattaatggccgcatgtaacggtaaatcaacgttaacaacagcgtttgaatatgggcaccatcaacatcggcatcggtcatgatgatcagcttatggtaattaatctttgataaatcaaagtcctcaccaaacccggttcccatggcagtaaataatgaacgaatttcttcgttggctaaaattcggtccatacttgctttttcaacgtttaatatttttccacgaattggcagaattgcctgggtcagccgtgatcggccctgcttagcggatccgccggctgaatcaccctcgacgataaacagttcagaaattttaggatccttactggtgttatcggctaacttaccaggcaggttgctgatttccaagccactctttttccgggtaacttcacgggcacgtttagctgctgaacgagcttttgaggccagcatcccacgatcaacaatttttctggccatcttaggattttccatcaagaacttggtgaaatgatcactgaaaatgcggtcagtcaccgttcgagcatctgaattccccagcttggtcttcgtctggccctcaaactgtgggtctggatgcttgatgctgacaacagccgtcgtgccttcacggacatcttcaccggaaaggtttggttcgttgtcttttaacagcttgttcttacgggcataatcgttaatgacgcgagtcaaggctcgcttaaagccttcttcgtgagtcccaccttcataggtatgaatattattagtgaaggtcattaatgtattgtgataatcgttggtatattgaatcgccacttcaacggtaattccgttcatgacaccttcaacgtaaattggttcatccaacaaggtttctttactgttatccaggtattcaacgtaatgtttgatcccgccttcgtacataaagtcttgttcagtcggcttttccggacgcaggtcaagaacaacaatccgtaatcccttgttcaaaaatgccaactcgcgtagtcgggctgttaagactttaatatcataagtagtggtctcccggaagatatcaggatccggcaggaaatgaaccttagtaccatggagatcatccgaaacttcacggacgactttcatcttggtcttgacgtgaccacgactgaagtccatgtagtaaactttgccgtcacgggtaacttcaacgtccagttcagaggacagggcgttaacaactgaagcacccacaccatgcaggccaccagaaactttgtatccgccgccgccaaatttaccaccggcatgaagaattgtgaaaacggtttctagggcaggcttgcccgtcttcttttgaatatcaaccggaattccacgaccgtcatcagtaacggtaatgctgttgtctttttcaacggtaacggtaattttggtggcaaatccagcaagcgcttcatcaatcccgttatcaacgatttcccataccaaatgatgaagtccttgtgaactggtcgttccaatgtacatcccgggacgttttcgaacagcttccagtccttcaagaacttgaatttggctggcatcatattcatgcgctaattcttttttggtttctttttcgtcggccattttgattctccttcactattttgccaaagtaacattaccttcactaatccgaaaaatacgtggattggttagtaactcctgctgaacgccacttaaactggtggtggttaaaaatgtttgaaccttatcttgaattgcggttaataagtgcgtttgcctgaaatcatcaagttcagaaaggacatcgtccaataatagaattggatattcatccgtttgttccttcatcaggtcaatttcagctagtttgaccgaaagcgcggttgtccgctgctgaccttgggacccaaatgactgaacttctttgccgttaatcacaaaatgcagatcatcacgctgaggtccaatcaacgtggtggaacgcaaaatctctttgtctttaatcgcagcaaaatgcttcagtagactctgataaatcgactcgactgatcctaactggtcagcctctaccgtggtgtgatagtcaaaggccaactgttctttaccttgtgaaatttcagaatgaacgttttgggcaaacttttccagctgtttaagtagctgaagtctttgataaacaatttctgcaccataagcagataactgatcggatagcacatcgagatatacccgatccttttggcgtttataatgcaaatctttcaaataccgatttcgctgtttcagtatctttttgtattgagtggaattgtacaagtagcgattgctcatctgggcaaattccatgtccatgaaccgccggcgaacttgtggtgctcctttaacgatggataagtcttcgggagcaaataaaatgacgttcaactgaccgatgtaggtggacaacttagcttgttccaaatggttaacctttgcccgcttcccttttgaacctaaatccagttcaatcggaaccgttccaagccgcttttgcaggcgacctttaatttgggccgtctgactgttccagttaatcaattctttttcgttattggttcggtgactgcgggtgagtgccaaaacatagatggcttccaataaattagttttaccctgggcgttttcaccaagaaagacgttgatcccatcggaaaattcgagcgtttgatcaacataattacgaaaattatgcagttcaatttcggttagcttcattcatttccctgctttgagcgaataaaaaataagccaacgtccggaacttcgacatgatcaccgtcatacagcttccgaccacggcgattgtcaggctcgtcattgacattaactgttgtctctcttaaaaaccatttggcttggccgccactggcaataatcgattcttctttgagtaattgtccaagagtgatataaggactatcagtgaaaacatcttttttcacaatttcacccacctttttactccttctattatacctctttgtttactaaaagtacacgtcaatgacgattcttgggcattatgagccgttttgaagatttttgatatttttgcatcaaaatggcaaaaactgctaaaaggtgcctatatggacttctaatgaaatgacgatcattttttaggattcaaacattatgtaaatgtgattgcagcatttttgaaagaaatcgatagcaagcaactcattttggtcagaaaaaaacaactcccagcctgtggaagttgttggcgaatcgatatttaattaaaacgttctgattggcgtaatcagctgaacaaaactgtcactgtcctcggttggtgtgagggtaaatggtcgcagagcagacgtgaaatcaatgttaattgtcgcctgggtgaatgaccgtaatgcgtctttcatgtaatcaggattaaaggaaatctccagttcattaccttctaatgacttgggctcaaggtcttcttcaacatttccgacatcaggagaattaccgtaaatagtaactgtctttttgtcaggatcaatcgtgattttaaccacgttatttctggattcatgtgaaagcagagaagcccgttcaattgcagctagtaattcaggtgcttcaaatgagatccgagtgtcatgtgaatctggaattaaccgagtggtgtcaggatagtttccttcaagcagtcgtgaataaaacagggtgttgccgatgacaaacagggcttgattttcggtaaccgataaagacacttcgtcttgtccatcatcaatcatcttggataattcagtcaaactctttccaggaatgacgaaatcatatgaaccattgatcggggtttcaagagtaactttccgttgactcaagcggtggctgtcagttgcgacggccataacgtggttatcggaaatgacaaagtgaacacctgttaaaatcggccgactttcctgattggaaactgcgacgaccgtttgactaataatctgtttgaaaagatcagcggccaaaggaattgagtcgttcgtttgaatttcaggaaggtgtggatagttattggcatccaaaccattgatagtaaatgatgattgacctgatgtaatcatcgtctggaagttttcgccaacctctagagttatggtgtctttaggcaatttcttgacaatttcagtgaagaatctggcaggcaacacaatggcaccttcggattcaataactaacatattgtctggatcatcggcttttaacgtggtttcaatggaaatatcagcgtcactaccggttagtaccagaccgtcaggacctgctacaattttgagtcctgtcagaataggaatggtggttttggtagagattgctcttgaaacggtgtttaacccttttgtgaatgctgttcgaccaatggaaaatttcatactttaatcgacctcccggaaagtgtaattatatattaattaataaaagaaaagagaagtaacagtagggcatgtggatattgtggataacttttcacaagtggcctgtccctaacgattaacctgtggataagactgtgcacaacttattgacttctcgatgatttatccacaatcgattatatcattttagttcagggcacttttgatatccgcgatttcttttcttaagtcggcatcaagtttgatgatttcggcaattttatcgcaagcgtgaataacggtcgtgtgatccttgccgccaaattccttgccgatttttggcagcgagttactggtcatttccctggaaaggtacatggcgatttgtctaggcatcacaatggacttcatgcgctttttgccctttaaatcattaatggaaatgtggaagtagctggcgactttattttggatatcaacgattgaaagctggcggttatcttggctcaatttgaggccacgaagcgcttcataaaccaggtcagtcgtaatcggctcatcttttaatttggaataggcttgaacccgcgacaaagcgccttcaagttcacgcacgttggaatcaatttggccggcaatataggacaaggtgtcgtttggaatgaccaggttatccaacttggccttatttttgagaatggcaattctggtttccagatccggcggggtgatatcgactggtagaccccaagcgaaccttgataccaagcgttcttggagcttggggatctcttgaggaacccgatcggatgtgaggacgatttgtttatcgttattgtagagatcgttaaaagtatggaagaactcttcttgggttccttctttttgggcaaagaattgaatatcatcaaccattaaaatgtcgacgtctcggtattcacgacgaaattcttcggtgcggttggtctgaatggcgttgatgaaatcgttggtgaaggcttcactggtgacatacttaacgttggtctcgggatgatcttcaaggcgcttattgccgatagcctgcatcaaatgggtcttacccaaaccgacgccaccataaaagaacagtggattataaagcttgccgggttcttcggacacaattaaagcagcggcatgggccatttgattgcccttgccgataataaagttatcaaatgtgtaattgggattaagatgattttccttactaaatgaaaactcatcgccatcctgatcttggctggcattgttatccacaggcttttcttgggcttctttattaacgtccgaatccagaataaactttggctcgatattgcctttagtgatcacaaaagcatactctatcaagtttggtgccaattgttctttccaataatcccgatgcaattcagaaggtaaagataaagtgagtgtggatccatcaaagctgatcggcttgactggtttgatccaggtatcatatgtaagatcagtggtgttgctgcgaaattgttcgcttaacttttgccataatgaatccttatctaacactacgaattccccctctgtttttagtcgtgtaacgaaatgcaaattaattttagcattccccagaaaagttttccacaggcaaaaacagcctgtgcataattgtttcacaggggtggatgaaatggataactcccctgtggataagtggataaggtcgttggaatttggtgtaatgaacaggcaactgtggataactaaagctgacaacaacggctttattcacaaaaaagttgatagaatccacatcctgtggataacttttggaacacggtgtgagcttgtggataaccttgtgcaaatctctaaaatcagctatgattatttctgcggttatccacactaattgttcatgaaacaaattttaaatattttttgaaatgtgcgatcattcaaaagactattccattaatgaacaaattatgttaatatatttgggaaatgcatttgaacataattgtaattaaatgcttaaacgcgacttttacagttaaaggaggaattcattatgaagagaacttatcaaccaaagaaacgtcatcgcgctcgcgttcatggctttcgtaaacgtatgagtaccagcaatggtcgtaaagtgttggctcgccgacgtcaaaaaggtagaaaatcattgtctgcatagaccactgaccattcagtggtctttttcatttatttttcaaaagtctgtggagatggatcatgcgaaaatcgtatcgagtaaaaaaagagagtgaatttcaagaagtctttgagactcataactctgttgcaaatcgtcaatttgttgtctattctttggataaacccaatcaattacattttcgcgtcggtatttctgttggtaagaagatcggtaatgcggtacatagaaattgggtcaagcgaagaattcgtcagtccttgttggaattaaagccttatcttcgtcaggacgtggactttattgtcattgcccgtccggctgctgaccagatgtcgatgagtgatgtcaaggcaagtttaattcatgtgctcaagttagctaaactaatcgatcccaactatgatagtgaggaaaaaagttgaaaaagagaataaagaaattactagtattactatcattagtaagtttgacggtagtactttccgcatgtagtaacgcaccaataaccaatcacagtacgggcatttgggatggctgggttgttttgaacttctcgcgggccatcatctggctgtctaaattctttagcgacaactacggaacgggaatcattatcttcaccattcttgtccggatcgtgattctgccattgatgatttaccaaaccagaagtatgcgtaagactcaagaagtccaaccgcagctgaaggcattgcagaaaaaatattcatcaagagatgcagaaactgttcagaagcttcaagcagagcaaaagaagctgtatgccgaagcaggcattaacccgcttgccggctgcctgccattgatcgttcagatgccaattctgttcgccttgtaccaagcaatttggcgaacccacattttgagaagtggaacgttcttctggctgcagcttggtcatccggatccatactttgtcttgccgatcctagctgccctgttcaccttcatttcttcgtggctggcaatgaaaggtcagcctgaatctaattcaatgaccacgatgatgacggtcggaatgccattcttcattttgattatggctattagcctgccatcagccctgtcactttattgggtgatcaccaacgcgttccaagtaggtcaaaccctggttatccaaaatccttggaagatccgtcgcgaacgtgaaaataaacaacgcgaagagcgtgagaaacaacgggcaattaaaaaagccattaaacgtgccaagaagagtaaacgtaaataattagcaagcagcgtgatcatttgatcacgctgcttttttgttgaacgatccatattcaggtacactaaggtcaacagttagttaaaggaagttgacgatgaaaacaattgtaattgcgaccgattcatttaaaggcagtgccagctcacaggaagtggcggagaatttgcaacggggacttacggcggccaatcccagtcttaaaatcaaaaaagtaccgctggctgatgggggtgaaggcaccgtaacagccattgtcaacgcgactaagggccacttaatatcgacgcgggtgtctggacctaccggcagtcaaatcgacgctaaatggggtcagattgacgatcaaacggcagtgatcgaaatggctgcagcggctggatacacgcagggccaaacgacagatgttgctgttcggtccacttatggtgtaggggaactcattgaagcggcactggatcacggcgtcagcaaaatccttctgggacttggtggtagttcaaccaacgatggtggcgttggcatggctcaggctttgggtggtcatttttatgatcgaaacggttatgagatctcccgtggaattggcggactcaaagacctggacaaagttgatttgacccagattgatcaccggatgtccacagttcaaatgatcggtctttctgatgtcgagaatccactgaccggccaattgggtgctacacggatatttgggccacaaaaagggattcaagatgaacagattgcggattttgatgcccggctgcaacgactggcgcgactgactgctgctactgtggggaaggacctttcacaggtaccaggagctggagcagctggcggtttgggatttggcgtcctggcctttctaaaaggcaagttaacgtcaggaattgatgaaatcatgaagttggtggacttaaaggcgatgctttgtgatgctgattgggtcattaccggtgaggggcggattgactcacaaaccctcagcggcaaattgccaatgggggttgccaaactggctgattcggccaaagttccggtaattgccgttgccgggagtttggccgccgatatccaaccattatacgatcaaggatttgacttgattgtttccaccacgacccgtccgctgaccgttcaagaagcgattcaccaagctcctcaattgattgagcagactggttttcgaattgggaagctgattcagctcatcaactaatgagatccggacgtttgatttagcgtccaaacttaaagcggggccaaggtatcagtcgaatacactgatgccttggccccgctttaatatatttatttattgcacgttttcaagtaatagccgagcgacagcccgtggtgagaatggattttggccagtaatcaagtgaccatcttgaatggcatactccttgtaagcccgcttctttttgaatttaccaccgcgcttttcaactgcttgattattcagaaagggaaccactgattttttgccggcgatgatttcctctgcagttgtgaaaccagtgattgacttgccggcaattaaatagcgaccggcatcgtccttaatgttgagtaaccctgcaactccgtgacaaacggaggtaatgtatccaccgttgtcgtaaattgacaaggcgatttgctggagagcccggtcatttggaaaatcccacatcactccgtggccgccagtgtagtagattgccaaataatcgtcgggattaatttcatttggccgcagtgagttggtcaacgcccgtttttgaaaatcctcagtttcatagaattttatgatcgattcgttagtgtatttcatactgcgtggatcaagtggcacaaagccgccctttggactgacatagtcgacgtcaatcccagccttctgaattgtttcggcaaattcagttgcttcccccaaccataaaccggtgggatcgttcgtgccttgataacgggtaacattcgttaaaacaatcaatacttttttcatgatttggtctccgtttgatgaatgattgctgtgacgtgatccagaagggtttttagttcatcaatttccttgatgtcatgggacaggtagtagaagttcttggttccttcacttctgacggccactaaatgggcatctttcaaaattttcaaatggtgggaaactgccggtctcgataagccagtgacactggtaagttcaggaacttgcagcccctcacaagaattggtttttaacagggaaatgataattgcttgccgtttttggtcccctaaagcagttaagaaactgctgacattggtaaattcagtttgaatttggtgtaaatcagccatcgtaagttcctctcggttcatatttttaaaccattaaaccattttatttctcagccgtcaacgaattggcattaaaccgtcttacttgacgtccgctgaattgtgatttatgatttggacaccattcgttcaaaaatttaaaccaataaagtggagctagtaataatgacaaaaatgatgaaagctgcccagatccagcattttgggcagcagcaattagagatcgcggacgtgccgattccaacaattagggatcatgacgtgttagtgaaagttgctgcggcaagtattaatccgattgatttaaagacccgcgatggcaaacttaaaatgctgttgaagtattcgatgccattgagattagggagtgatttttctgggacagttgttcagacgggaacattggtgaaggacttcaaggttggtgatgaggtatatggtcgggtacagaagaatcggatcggaacttttgccgattatttggcggtggatcagggtgatattgccctgaaaccggccaacttatcactggtggaatccgcagcactgccgctggtttcgctgaccagttaccaagcgttaattgacttgatgcacgttaagcctggagataaagtcttgattcaggcggggtccggtgggattgggacagttgcgattcaactggccaagtcattgggagcctttgtggcaacgaccaccagcgcaaagaatacgggtttggtcaggcagttgggggccgatcaggtcatcgactatcatcaaacggcatttgaagatgtcttgtttgattacgatggcgtgtttgatacactgggtggttcacaattagctaacgcgtttcaagtcgtgaaaccccgcggcaaagtagtttcaatttcgggtctgccaaatcgggcattcgcccagcaggctggcctgccaatgtggaaacaactggcgttttccctggctacagcaaaaatgaggcgactgcagcgccaatttcaggttggctatgagtttttattcatgaaacctagtgggacccaattgtccaagataaccaaaatggtcgaacatgggacccttcagccggtcattgatcgggtggtgccgttttccgatatccaatctgctatggattactccgcagccggccggtccgttggaaagattgttattaaaatggcttaacgggtagagttcaaacaaaaagacagcgatgagattgtgctcatggctgtccttttaaattacaatcgttttcgattatcctattgatatctcatgccaccatccactagaattgattggccggtgatataagcggcatcaggggatgcaaaccacgaaacgactttggcaacgtcttctggtgtcgcttctctgcccagtgagatttcactgaggcagtttttttgttgttcagcgacagagattcctttgatttcagcggtccgtttgtcgatgccgtctcttagaggtgttctgacaattcctggatcgtaagcgttaacggtgatttggtcctttgccaattccttcgaagctgcttgagtaattccccgaacgccaaactttgaaatcgaataagcgctttgcagagcagatgcctcaacaccggccagggaggccgcgttaacgattcgaccaccgtgaccctgttttttgaattgttcggccgccgcctgggttccccaataagttcctaataaattgacatccaataatcgccggatgtctttttccgcggaatcaacaatttcgttgatgaaagccaccccggcattattgacgtacacggcaagctcaccaagatcggcaaccgctttttgcactaattcaaagacccgttcgcggtcagccacgtcgatatgatacgatttggcagtgtagccgtcgttagtcaagtctgcggttaccttatcagctgtttccccattgatatctgcgactgcaatcgcgaacccatcttttgccagtcgatgagcgatgccttctccgattccttgtcctgcgccagttacaattgctaattttgccatgattgccaccccaaatttataattttttattcattaaatgaaaaaacgcttctgcagccaatgctgcagaagcgaataacactttaccattctgatttatttgacgattactcgtcaaaccttgataaccatcgaaagtcgatggtgtgtctgctaacggggactcatccgtctgctgctcgttattgactcacaacaaccaatcatcggccatcttcatttaagttgaatattggcttccatcagcgccaactctctgatagacaacttcaaactactcaccgattcattttgtttaacaaattatcatttaattaaaattgaatatagcgctgttttttttatttgtcaaaccattttgattaatctgccgaatgcggattgtctttttgactgaccggatagctcatcacatcggcatcgagaatatcgtatttctccatcaaattgtgttcaactttttcaccaattgcataggctgtttttaaatcggtgtcatcatccagatagatgccgattttcatgacaatttgatctccgagccaccgtggctcaatcccttcaattccgaggaccccagggatggcactaatggtctcactataacgttgaatatcttttggatcaaaaccttcactcaatctcataatggttgttctaaaaatactaattgatgagtggagaatcaggcagccgacaatcaaagttgccactccatccagccattgggcccccaggtaggcaccgccaatggaaagaaatgttccaaagctggtccaggcatcacttttaaggtcttgtccggaggcggtgagagcttgatttttcagctgaatacccttggttttattgaaccgggccaagatgccaatgatcatggctgcaatgatgctgacgcccagcgaccagtcattcggtcgaatggtgtgaccagccaggaatcgctggacagcaaaaacgccgtcaacaaaaatttggatactgactgcaaacatgattgtcgcagataaaagtgcggcaatattttcatactgccagtggcccatcacgtgattggagtccggtgggcgcttggacattttcaggccaatgattaaaatagctgcaccacaaacaccggtgaggttattcagcccatcggcaatcaaaacggtaatttgtgccaaatacccaatgatcagttcggcaaccatgatggccgagtaggcactcaggttgacccaggtgatctgcgaggcttcctgaagcttgctaagtcggtgctgacggtcgatttgaatgtttcggccggcgtcatattgatttgtgtttgccattttatcacttcccaaatcgaaaacctaaagcagccgtcactatagattgatgtcgattcagacgaaaccatctttcttaaaaaagctactacaccccattatatcgactttgtagtgagatggtagtttgatgctttgaaatgtgacaaatcatttaaagtttgcgtttagtttccgtttttcgcaacaaaccgtttaataatgcgcgtttttatgctattattaaccagttaattcaaataaagggagttcattatgacaatttactctggaaaaaccatccaagacgccgtagaacagggtttaaccgcactatcactcacttcggaccaagttgaagttaccgttattcaacaacctaagaatggatttttaggtttcggtcgcaaacttgcacaggttgaacttgtcagtaaaactaacactaaacaacagacaaaccttaataaatcaactaatcatccggtttcagaatcaaaacagcatgaggaagaaactgaaaacgccgttgacattgaagaagtttcccaaaaacttgccaactatttgaacgatgttttagaagcaatgggcttctcgttcaaattgaagctcgatttaaagaatcggcattcaatctatattgacattgatactgaccaggagagccgcttaatcggccgtcatggccgcacgattaatgcgctccaaaacttgtcacagatttttattaatcgactgggtgccaacaacgttaccgttgagttggataccgcaaactaccgttccagaagaagcgagtcgctggttcaactggccgataagactgctcggaatgccattgccaacggcaagccagtctacttgaacccaatgccggcatttgaacgcaaacaaattcataatgctttggctgacaatgatcacgtgatgacgtattcaaccggcaaagaacctcatcgtgtcattgtcgttgcaccaaaatagttctcaaaatcaattgacaaatgcattgctttaaaatattatgtaggtaatcattcttatcttaactaggtaaagtagtcaaagtgctttatccatgctatcttttttggcatggagtggcgctttttttgtgcttttagataagttttgtggttaaattagaacactattcaattattcgtggagggaagcttaatcatggttttaacaacaacagaatttgatacgattgcagcgatttcaacaccacctggtgagggcgggatttcgattatccgcattagcggtgaagaagcacttgatgttgcaaaaaagctctatcgtggtaaagaccttgataaagttgccagcaacaccattaattatggccacatcattgatccggataccaacgaagaggtcgatgaagtaatgctctccgtgatgagagcccctcacacttatactgaagaggatattgttgaaattaactgtcatggtgggattgttgccaccaatcggattcttcagttggcactgagtcacggtgccagaatggccgagcctggtgagtttaccaaacgggcatttctcaacggccgaattgatttgtcacagtctgaagccgtcatggatctgattgaagccaaaactgaccgttcaatgaaagcggcgattaatcaattggatggtaatctatcgcatttgattaaacatttacgccaagatattctcgacgtgcttgcccaagtagaagtcaacatcgactatcctgagtacgatgatgttgaaaccatgactagtaaattgttgcgggaaaaggcgaccgatgtccatgcgcgaattgtgcaactgctgaagactgccaaacaaggcaagatcttacgagaaggtttggccacttcgattattggtcggcccaacgtcggtaagtccagtttgttgaacaatttacttcatgaagacaaggcaatcgtgaccgatgtgcccggtactaccagagatgtccttgaagaatatgtcaatgtccacggcgtgccattaaaattggttgatacggccggaattcgcgatacgactgacaaagttgaaaaaatcggtgttgatcgttccagaaaagccattaatagtgccgatttggtgctgctggtgcttaacgccagtgagccattaaccgatgaggacaaaaagttattgagtgccactcaagacaaacagcggatcatcatcctcaataagactgatttaccaaccaaaattgatcaagaccaaattaagtctctagctgacggccagaacgttatttcgacttcagcgattaaggcagacgggttgacgcagctggaagaattgattgccaagatgttctttgatgaaggaattgaaagcagtcaaaacgacattatggtcaccaatgcccgccacatcggtctgttaaatcaagccaaacaggctttggaagacgttgtcaaaggattggatgatggcatgccggttgatttggttcaaattgacatgactcgctgctgggatttcttaggtgagattaccggcgacagttaccaagatgagttaattgatcagttattcagtcaattctgtttaggaaaataacctgtttcacgtgaaacatttggaggaaaaacagtgaaaagtttacgagttagcgatgttaaacaaaaatatcgcggccaagattatgatgtcattgtcgtcggcgccggtcatgcaggctgtgaagcggctttggctgccgccagaatgggcaacaagaccctcttgctgaccattaatttggatatggtggcatttatgccatgtaatccatccgttggtggccctgccaaagggacagttgtccgcgaagttgatgctttaggcggcgaaatgggcaagaatattgataagacatacatccaaatgcggatgttgaacaccggtaaaggaccagcagttcaagcgttgcgtgcacaagctgataaacatgcctatcacgccgagatgaaacatacgattgaaaaagaacccaatttgactttgcgtcagggaattgttgattccttgattgttgaagacggtgtttgtaaaggggttatcaccaatactggcgctgagtgttatgccaaggcagttgtcatcgctgccggaaccgctgctcgtggaaagattatcattggcgagttgatgtacgcttctggacctaacaactcacaaccggctgaaaaactttcaggcaacttggaagcgctcggttttgatttggagcgtttcaagactggaaccccaccgcgagttgacgggacaacgattgactactccaagacagaggaacaacctggcgatgagaaaccgcaccactttagttttgaatcttctgatgagaactacctggcagtcaaagaccagctatcctgctggttgacctacacgaatgaaacgacccacaagattatccgcgataatcttgatcgggcaccaatgtttactggtgttatcgagggagtcggtccccgttattgcccatcaattgaggataaagtggttcgtttcgctgacaagagccgccaccaactatttttggagcctgaaggcagaaaaaccgaggaatggtatgtcgatggcctgtcaacttcgatgcccgaagaggtccagcaaaaaatgattcattcaatcgtcggcatggaaaatgcccagatgatgcggcccggctacgcaatcgaatacgatatcgttgcaccctatcaactgaagccgactttggaaaccaaagttgtcaaaaacctctttacagccggtcaaaccaatggaacatcaggctatgaagaagctgccggtcaagggctgattgccggcatcaacgctggtcgtcgcgcacttggcaaagggccatttgtcttaaaacggaacgaagcatacatcggcgtcatgattgatgatttggttaccaaagggaccaaagaaccataccgtttgttaaccagccgagcagaatatcgtttattgttgcggactgacaatgccgacatgcgtctgacagaaaaaggccacgagattggcttaatttctgacgagcgctacgctaagttcttagctaagaaaaaggccattgaagctgaatttgatcgtttgaacaccattcggattaagccgtcagatgaagtgaaccagtttgttcaggaacacggtgacaaaccgttgcaagacggggtactggcatcaatctttctgcgccgaccatacgtcgattaccagacattgatgcggttcattccccaagcagagacaaagcctgatcgtcacgtgatcgagcaaattgaaattcagaccaaatatgccggctatatcaagaaagccgagcaaagtgttgaaaagatgaagcggatggaagctaaaaagattccagaccggattgattacgatgcaattgatggcatcgctaccgaagcccgtcagaaactgcagaaaattcatcctgagacaattgcccaagcatcccgaattagtggtgtgaaccctgccgatatcgcgattttgagcgtttatattcaacaggggaagattagtaagctggctgagtagttttaaagtctaatgaaccgctctaccactttggctgccggttcttaaatatgatcatttagtcaacagcacaataaaaacggctgagagcaaattttgctcccagccgtttttattaactgagtgagcgttgcctattatgaatagtactgaaaagaaataaactcaaccccatacatcccataattgccactgacattggcagataggtcccagtccccatcaatccgaccaacggtgacatgatcccgccaattgcattttgcgacaagcccaacattgctgaaagaccaccgttgttatgtaatgtcaggttcatgataattgaagtggttaatgtaaataacattccaaattgagtaaccgttaagaacactaagatgatcaccagcaggagattgttcaagaataaggcgctcaatgttagtaaaacagaggttataaaggtggatgtcaaaataactttggtttgaccagcttcactaaagtgtcccgccaaggcccctggaatgactgagccaatggcgatcccgatgccattcaatgcgtagagtaggctgaagttttgaactgacatgtggaagaagttctggaatacaaatgatgaagcagaaatatagctgaatagaccaccggagaccaatccagttgccagtaccaggcggacaaagcgcgagtttttcaataacttaaacatttggccaattgatttccccggactgccagaaattcgtttctcttgaggtaaggtttccttaattcccagccagagtgccaggactaagacaaatccaatgactgctaacaggatgaaaattccctgccactcgacatagcggatcataaagccgccaatgactggtgagatgaccgggaagatcccattgaccgctgatagcatcgagtaaaatttggttagcagaggccctgagaacatatctgaagcgattgcccgggagagcacctgcccacttgccccagccagaccctgaatgaaccttaagccgatcagcagataaactgaactgctgtaggcgatcatcaaggataccagaccaaagatgaaaaacccgatcatcaacggcttcttgcgcccatatttgtcacttaatggtccagaaatcagctgccccagggctaacccgatgagacaggcacttaggctcagctgaatgagtgaaggctgggcggataggtcacgggtcatttcgggaagggccggtaaatacagatcgattgacagcggtccggttgcactgatcgttcccagaataaagatcagccaaattttatttcctagttttaggtttgtgttcatgttgttacctctatttcacaagcggagtcatacaaattatgatacagtttgattgcaatatgagcaataaattagggttctgttaattaagcgcgaaaaagttgttctggcgggtaaatgtgataaaattaatatcgattgtgtaagctaatcgttatggatagtatgcatagctaattgtgttgttcacaaaggagcttaagatgaaagtatttaaagaaattatgagctgggtaatccccatcttggttgggctgctggttgccctattgattcgccagtttgtcttcacgttcgcccgggtggatggtccttcgatggaacccaatctcgttaataaagagcgcttgattgtttggcggcatgccaagattaagcatctgagcgtcatcgtttttgatgcccatggtgaagatccaacggctaccaagcctaaaaccgactatgttaagcgggtgatcggcctacctggcgataccgtctccagtaagaacggcaatatctacgtgaatggaaaagctgttccccagaagttcattagcatgagcgaacggacgactggaaccggcaattggaatttgaaatcattatccaagagctgggacaaaaataccaatgccaccaaggttcccaagggtgagtatttcgtccttggtgaccatcgaagcgtctcaaatgacggtcgttattggggctttgttccaaagaagaagattaccggcgtagcaaagaccttcttctgggaaaccaacaagaccaaacgaactaacgttaacagtctaggctattaacgataacttaaaaatctcactaaaagattaattacgcaatcttttcgtgagattttttattcattgtaggaaataatatgcggcgtgtcggtcacgtccagctgggtaatgctaccgttacggggctgcttaacaactgttgcatcatcagtatataaagtcgccaggtttctcagaaaagttccatgtgaaacaaccaaggcgttctgaccgtctgtcagttcagattgaatatgttcgactgcactgttgattcgactctcgaggtgagcagaagtctcggctttgtgaaatggatcggcggcatgcatgaaatcacgcattttgaggaggccatattcttcgatcaagtcctcttgattacgatgtcccagcggtccgccaatcatgttccatgtttggatactgtcgattccctcaaatgagccaaagtaaatttcgcgaacgtccagggacacttctcgagaaacgccacccgaagcatgattatttgccagaataatgtctaaagtatgaatcgcccgcatcatatcggaactgattgccaaatcaaaatggacatcagcaagtttttccccagttgcctttgcctgggactcgcccttttgagtcaatggtgagtccacccagccttgcatccgccgaaattgattgagtaacgtttgaccatggcgcacaaaataaatggttttcatgttgaatcctttcaaatgttttctgtatccaattatataagaaatcttgataaacaacacccctatctaatcgtttctggaacttcacaatttcgtcacacttatttaaggctgagttaagttggcaaccataatataaagacaatcaattttgaaagataaattggtttacaagtgaatttactcctccaaagtataaaacttgattatcttacgtctcccccaagaagtaagatcccctctaatatgaatatgatttgtagcaacgcctgggccttagtaccgggcgttttttgtggtttgcccacaattgggattataataaagataatattgaaacgattggagtcagtaaaatggatcatcaattaaccaggttgagcaagcgtctgtcgtacgtcctcagacaccatccggacaaaattggcatccagttggatcgatatggacgagtggacttacaaaccctcatccaaaaatttaaccagcactttgggacaccaattagtgagaaaatcattcgagaaattatgaaagatagcgacaaacaacgttatgcgattgaaggtcacacgattagggcgctatacggccacagcatccccgtagatccactgacgccacccgttgaacctccagagaagctgtaccatggaacgactcatgcggctgccagattcattgtcgacgaaggattaaaaaagatggaccgggattttgttcatttatccgcaaatccccaaatggcgattcaggtggggaaacggcgtgatcctcatcctgtgatttttgaaattgaagcaagaaaagccgcggcttcaggactgttattttatccaaccgaaagtggcatttggttggtggattcaatgccggctaagtttctaaagattatcaatcagtaatgatattttagtggaggtcaatatgagtgatcaggcagatgagaaagaaccgaagccaactaagattcgccggccgatgcagggcaactgtccaaagtgtcatcgaccaatgtctatcagttacggcttgaacaggtgccctaactgcgggtttatattcaagtcgaactttaaggttgaatagggttgatcagattcattgaagaagttcgcaaggtcaattggtgagcggtttgcgttcattgattgcccttttttgctgcctaaattttacaaaagtcccaaggatttctaaagattatgcggcttccttcccaattttaactaatttaagtcccaattaagcttgccccgatattctagcaacatcaagtatgaagggagggcaactgaaataggttccagatcaaaccaacaaacgttaaattgaaaggaagttatcatccatgaaaattaaaaaatatttagtcacatttggggctgcagccgcaatggttgccccaacatttctgagcagcgtcgttgccaatgccgatgcagttcaacctcaacgacaacaacaaggccacaaacaagacaatgccaaggccgctaagcaggtcggcggtaaaaatctgtcccagcaacctcgtgagacaggcagtcagtataccaatgacaattctggctacaatgtgaccgtcaaggcaaccaacctcattaatactttgcactacaatgttaaaacgtcaacggatagtggcgcctccagtgctgatccattttcaatcagtatctacaaagatggtgaactatacaaaacgattagttcatccactggcacattgagcggtagcctgtgggtcggttccggaacctactcaattaaggtatataccagcagcgctgccagtcactggacaggcggtctggcaacatcataatcaactggattttcgagaataaagttttcattttggtcaaatgaaacgattgtgggagtgggacgcgaggcgttttgatcccagagtttaagtgaagaaacgagttattcctgttttgggaatgacccgtttctttgcttaaatggccgggatcagccgatcagcaagtaggctcacaggccttgacctcacaacatcaaaaaattaactttgacatttcgtcaattcgttatatcataaaaccagccaagtaatttgtggctaattgaataaagtagtctggggtgccctaaacggctgagataaatacccattgaacctgatgcagttaggactgtcgaaggaagaacgaaatttttttgtgtgagcaaatagatataaagtcgattcaacttttaatctgttccctctttcttcgaggctttgaagaaagggggattttttgtttccaaaccatagatgatcaaataattggagggagtcgaagttgacagataaacaagcgttacttcaggcagttgatgcgcaccaaaatcaactgttagcgttattggaccggctaatttcatttgaaacgatgtcaccacctgcccgcaacacagtggcaattcaacgttttcttgatgatgaattaaccaaaattggatttaagactaagcaagaagctttttatgatggcgatgagctgctctcggctgagaaaccggggactgatgcagctaactatcatagtttgctgttgaatggtcatgttgatgtggctaccgttgatcgtcagagttggcacaccgatccgttcaaattagtccacgagggtgatctactctacgggcggggtgtcagtgacatgaaaggtggtatctcaagctttgtgtacatcttttcactgctccaacagcttgggattgacctgcctggagatttgcggttccaatctgtcgttggtgaagaggctggagaagccggaaccaaaaccttactgaaaaatggtgaaacggctgattttgcagtggttggcgataccagcaacttgaaatttcaaggtcagggaggcgtcgtgaccggctggattacactcaagagtccccacatttaccacgatgggaaccgagcagcaatgattaccactggcggtggcctgaaagcggccaatatgatcgagaaaatgatggtcgtgattcaggctttggagaaattggaacagtactgggggattacaaagcgttatcctgggtttgccccgggaatcgatacaattaaccccgcttatattgaaggggggttacatccggcttacattccgagcgtcacgaaattatggatcaccgtgcatttttacccaaatgaaaatgttgatgatataacccatgaaatcgaggatcaagtccttgctgcggcaaaagccgacccttggctgcgggataatctgcccacctttacttggggcggtgattcgctattagtcgataaaggcgaggtgttcccgtcactggagctagaccccgaccatccagggatgaaggcacttgagagcagttttgccgaagtggccggtaaacaaccaaccttggggatgtcaccgtccgtatcagatagcggttggtttggttactgccatattccagcggttgattttggaccgggaaccatggaacaagctcatagtgataatgaaagtcttagttttcagcaattattaacgtataccaaaattatggccgcattcatttatgattggtgtcattcaaaaggagaaaaatcatgaaaaagaaatttcgcttacaggatgtgattctgttagccattgttgcaatcgtttttggtgccatctttgtcgggacagattatctgtataatttcctggcagttgccattggaccattctcaaacgaggcactgtttggcctttggattatggccggaccattgtcgatttacttggtaagggtgccgggagcggcaattattggtgaagtattaggtgccgctgcagaggtcatttttggcggaacctttggtgctagtgcacttatttctggaattgtgcaaggaatcggaagtgagcttgggttcacgctgtggggatacaagaactggggttggccggtactaactacctcagcggctacgaccaccgtcgtttcctttggatatgaactgttccgtctgggttatgtccattatcacctgccaatgatcttggcattgttctcagtccgtctgatctccgtgttcttcttcggggctgtctgtgtccgagcaatattcaagatgctcagccgctcgcaagtgctcagacaagttcaatagaatatatgaaaactaaagggattgcggcaaaatgatcagttttgccgcaatcccttttttcggtttaacgagctgtagtcgatactttagcgatcttgacgattgttagaaaattgttgataatctgttttcccacttctggatcagtcatgattgattctggatggaattgaacgccatagaccatcttggctggattgctgatcgccatgatttctccgtcatcagttaccgcggtgacatccaagctatcgggaaccgttgttggatcaacgatgagtgaatgatacctggctgcttcaaaatgacgtgggcagtccgcgaagagtggatcgtctaaggaaacttggatatttgagggtttcccatgcattaacttgggggcgtgcactactttggcccccaaagcttctgcgatggcttgatgtccaaggcaaacgccaaaaatcgggaccttgccgaggaatgcgtctaagatcgccggcatgttaccagcatcttctgggcggccgggtccgggggagaaaatgacgctttcaggatttgctttcattaaattttcaacggtgatggcatcgtttttcaccactttgatctcttcagaggtctgggtgccaatcaattggtataggttgtatgtgaaactatcgtagttatcaattagataatgcatcgcaaacgcctcccttggctgctgtttcctgcagtgccgtcacaattgctctggctttgttgttaaactcctggtattcatgtttggggatgctgtcggcgacaatcccggccgcactgcggacgactaaatcgtcacctttccgatatgctaatcgaatcccaatacacatatcgaggtcaccatcaaaacccagatagcctaggcaaccaccataaaggccgtgtttgttgttttccagtttgccaataatctgcattgcagaaattttgggcgcaccggaaagggtccccgctgggagtaatgaatgaatgatatcaattgacgaaacgtccggatcgactttactttcaaccacggaacccatgtgcatcacgctcgagaacttcagcaggttccgatacgcggtcactttgaccgatccaaattgactgatgcttcccagatcatttcttcctaaatcaatcagcatattatgttctgataattcttttggattgtgttgtagttcgtcggcaaaagcgtcgtcttcaatctgatttttccctctccttctggtgccggccaacggatacgtgaataatgtttggcctcgtttggtaatcatggtttccggtgaagcaccgattgtttcaaaatcgttgtggcgaaaataaaattgatacggcgatgggctttctttgaataaagttggcgtggcagcaaacagcgaaccggtcattttggaatgttgcggattggagagctggacttggaagatgtcgccatcgacaatgtgatgttttgcttctgcgaccttttcctcgaattcgcttaaagagaactgcaatttgaatggtgtcattgtaaatggggggagcggctgttgctcatggacttgcagaatttcctccttcagattggttaagccacttattaccgattcatattgcgtcgtgagctgatcggcagggatcacttgaattaacgtgaccattttggtcgtgtgattataagcaatgacccgattaatgagcaccaggtcgacatcattgagtttcattgggtcactgacggctggtaaatctgcggtagtcgcatagcgagcgtagtcgtaactgaagtaaccgacgagcccgcctgaaaatggcggcatgtgtttcagttttggcattcgattgtccgccaaaatccgttccagaacaggctttaaatccgttgtttcatgtgaaacattgccttgctcatccgagcgggttaagacgccgtttcgataagtgatggtcatcgtcggattcaatccgataaatgaatacccgtcttcctgcttcttcggttttccagttagtaagaagcatggtgcatctggttgatcgaatcgttgcgtcacagcgatagggtcaaagtcctgcattgcaaaattaattgaaattggtatagctgaaaaatcctttgtatattgtttaagttggtctagattcatgatggtgtcctccattactttagtgtgttttgctaaatgctaaagttggatttgccatcgttttcttgatgttttcatgaaatgttcctccatatttgggtatttgctggattgcgtcatcctctgattgacatatttttcacgcatgtcgaggagcacgtttgttaagcctttgtgtgctcccttctgctttgaaaatacgctccgacggccgggtgaaaccctgcctagcctacttggcgacgggccagaggctaacttctaagtgcactttaattaaagttccaaacccaggaacttcaatcaaagtacccttagaaaccgcctctcccggccctcgtcgcgctctaaataaaaaatccgccccaaatgttttcacattaaggacggatcattccgcggtgccacctttgtttaattgatcgaaaaagacagtccaccattcagtagagtcactcttttccgtcaactacgcttagcaagggaccaacatccctccgacaactgacgtatgccaacacgtttcttcgtactcgatcactttcggaagaaccctcggtggtccatttaactgcttgcgttcggccgcattctcagcaatagcgactctcttgacgtgcacaacaatcttgatctccacttcaatggtttatttaggacggtatttaattgccattaaaattacgctctttatgagaagatgtcaagaaaattcataatttaaactttggggttgacacatcttggaattcattatatgctctatgcaattaaaatttaactttcttaggagattctaatcatgataaaaattaattcaaaaattaatcgattttattactattggttcgtttagtgttcacaccggacaggatgtgggcactcactcacatcttgtgcggccaatagtatttcatcatgattacttacttcggtcacacagttatttaccaaatatactgcgggaccaatttttttacccaaaattctgactcccgtagtgttgtacacactgtgggagttttattttattcaaaaacacgtcaaacacagaaatggagataatattatgattattgtacttaaaaacggacacgaagacattattgacgagatcaagagtcgctttaccgaaaccaacgaggtatttgttcataacaaccgcgtggcaatccaaggcgtaagtgaagatggcttaaatgctgaagaaaagaatgccattgacttaatcatcgacaacgttcccgccgctgttcaggggagccgcctctttcacccggaagacaccgttgttgtgacaccgcacagtcaaattggcggcgataacttcacgatgatggcaggtccttgctcagttgagtctgcggaacatgtcatgaagatggctaaagttgccaagagtggtggggccacaatccttcggggcggtgcttttaaacctcgaacctccccttactcattccaaggtcttggcgaagatggtttgaaatttcttagagctgccgctgacgcttacgacatggacgtgttaactgaagtcatggatcaagaccacgtggcaatggttgaacaatacacggatattttccaaattggcgcccgaaacatgcagaacttctcacttttgaaggcagtcggcaagactcagactccagtaatgctaaaacggggaatgtctgctacgattgatgatatcttaaatgcagctgagtacatcgccgctggtggcaaccataacatcatcattactgaacgagggattcggacatttgataacaaatacacccgcaacaccttagacgttggcgcagttccagtgcttcaaaaactgactcactacccagtcatcgtagacccaagccatgccgccggccacacagaatttgtgactcccgaggcattggccggagttgcggttggtgccagtggtttagttgttgaaattcatgatgatcctgctcatgcattctcagacggcgcccaagcacttaagccagatgaataccgtgcgatggctcagcaggcatttgcaatccggaaagtgatcacgacccctgtcgaagaaaaaagtgaggttaaattatgaaaatcattaaagttgatttaccagatcgttcatacaatgtcgaaattgcccgcggaatccttgggtgcaccggtcagttggtgtccagtgtttggagcaagcgcaaaattgccctggtgagtgacagcaacgttgcgcccctttaccaggcccaagtcgctgaggctctagaagctgttggcttcactgttcacgagtaccaatttcccgctggtgaagaatcaaaatccgtagacgttttagctgaccttgcccggcaaatggccgctgacagtttcaaccgcgatgatggtgtcattgccttgggtggcggtgtgaccggtgacctagccggttttctggcagcgacatacatgcgtggcatcagcctgattcagatgccaacctcgttgttggcccaggttgacagttcagtcggcggtaaaacggctgttgacttggataccaccaagaacatcatcggctcattttaccaaccggatttggtaattatcgatccggacactttgaaaaccttaaaaactcgcgacttggttgaggggtacggtgaaattgtcaaagtggcggcgttatccgatggtgatttgtggaacttagtcaaatcaatcaactcacctgaagacattttggccaacgctgaagaattgagtattcattcgattcaatacaaagcagacattgtcatgggtgatgaaaaagagggtggcggcctccgccaattgcttaattacggtcatacaattgggcatgctgttgaagcgctctctgacggtggccttcgccacggggaagccgtcagcattggcatgattgccatgcagcagatttttgaagacaagggcttggccttgaccggcatcactcaagaactccgggaacgtttagaagcggttggattgccggttacttcagatttattggattctgaccaagtatttgaaaagattaagaatgacaagaagaatcgtgacggtcatttaagtttgatctacattcacacaattggtggaccggttatcaaatcaattccgagtgaccaagtcaaagatttcttggcaattaagactgttaaagcataatgtttcatgtgaaacaatttaaatgcagatttatttctaattgaggttgggacattaattgctacggcggctttcattgccactttgattgccactgttatattgataaaacgtgcaacgatcggctgatcccggccatttaagtgaagaagcgagccattccaaaacaggaatagctcgcttcttcacttaaattctgggatcaaaacgcctcgcgttccactctctttttgttccctttttcaaaaaagcgtaaactagtattgagatgaattttaaatgtaaaaggagggatctcaatggctaagccacgtccacgtgaacaaacctatgaatttactgataaaccctcctaccgtgaatggctgattgagactgttcgagcggcgctgcccgatggcttggaactggccgccagcaattatgcccgctccacggccagttcatactggctgattaaggggtatgacgatcatgatcaagttttctggctgacacttcggattgccactcatcggctttggctgcagaacgcccaccaaattgaggtattgtgggaagagccggggacctttggtgatttatttaatgcggtgtccaacagtcttcacccagtggcggtccaaaacgcaaaatttactttgagttcgctggacattgctgtgttgaacttgctgatcgctcttgaacaccacaaattgatttggttcattagaatggttccagacatcgccaaggcacacaaagataagttgttcgatttaaagagcgacttcctcgattgccaactattgctgggcgaccggaacaatgcgaataatctgttactaccagttgatgtcccagcgtttcagcatcaattagcgacatattttggcgaaaatctcttattctcacaatttaccaaacattcattgcttaaactcttacccaccaaccaatggatccagccaatgcttgatgagcagggaaatgatggtgaatgggaagatgaggttagaaccgcgtatgggcaggactttgtcgaattatgtcagcgtgagttgaagcatcaagcaagaatatataagaaaaccacctagcctttgaatggccaagtggttgttgatgtccgattaacggttactggacgtgagattgctggttgcctttattcttaaataaatatccaaatcccctgatggttgttagcatctggggattttttggttcgatttcgatctttttgcgcaggttactgatatgggtgtcaataattcgcaaggtcgccccggtggtgttaccccatactgccgaggcaatctgggttcggctgagaacggtgttggaattgctgacaaagaatagaagcaatttatattcgattggacttaaattgagcttttggtggccgttattaacttcaaatttactcaaatcaatcttcaagtgaccgaccaccagactttccgactcctgactctgctgtgtcagctggagattgtctttattttgatagacccaaattttttgaacaattctggcgacaatttcacttggtgattcgtcataaatgtaatcatccaaatgataatccaaaaaataggaacaaatcgtttccacggaccgtggctgtttatccagcagcaagattggcccggcaatttgactgcggagaatctgcagttccgaatcgttttccggcagttcagttgtgtctaagtcccagacgactccggaaacttgttgaagcagatgatcaaggggttcaaatgagattctggtattaatttgaaaggcggcaagtagtttctcaagcttatccgccagctttaagttctggctgatcaataagatttccaatggcatccggtcttcctccatattagttaaattgtttacatcttaagttatgccatactttttgataaaaatggccggttttacgttacttttacataaacgaaactcgatatttacatgctgttgttatattaacaatgtacttaaatgagtactaaaaaaacttgggttttcattaggaggaaatcgaattatgaaaaaaagatcctttttttcaactatcgtagcagtagcagctgtcggagttttacttgcggggtgtggttcgtccagcagctctaagtcaaagaaaagctcagctgattcgaatgtcaagatcacggcggttggttcaactgctttgcagccattagttgaacaagcagcaagcaattatcaaaaagcaaataaaggggttaacatttctgttcagggtggcggttctggaactggtttgagtcaagttcaaaccggcgcggtacaaattggtaactcagatatcttcgctgaacaacaagatgggattaaagcaaaaaaattagttgatcatcaagttgccgttgttggaatgacaccagttgttaacaaagatgtcaatgtcagcaatttgaccatggcacaattaaagggcattttcactggtaagtatactaactggaagcaggttggcggcaagaacgaaaagattaccgttgtgaaccgtgcgcaaggttcaggtacgcgtgccacatttgaatcagccgtccttgagggtgccaaagcagttaaggcccaagaacaagattcaaacggaactgttcaaaagattgtttcaagcacaccaggaacgatcagttacttggccttctcatacgttaacagcaagctcaaggcattgtcagttaacaatgtaaagccaactgatgccaacgtaaccaccaacaaatggaagatctggtcatatgaacatatgtacactaagggtcaaccaaacaaagcaactaagaagttcctgaactacatggattcaagcaaggttcaagacagcttagttcaaaaacttggttacatcagtattcatgatatgaaagtaacgaagaatgcaagtaatgccgtctctgaaaaatagagcgcgacaagggccgggagaggcggtttctaagagtactttgattgaagttcctgggtttggaactttaattaaagtgcacttagaagttagcctctggcccgtcagagcgtattttaaaggcagaagggagcacaaaagcacctaacaaacgtgctcctggagaggcggtttccaaggacactttaatcaaagtgcacttagaactcagtctcatggctcgaaccaagttttcactaggtaatcttcacgcaccattaactctacaaactaaacacaaaaccaacgaaggctgaaggcaaatcaaatgcctccagccttcctcaagttaaggtactcatttaaaattcattcgactaaattataggaggttaatcatggatgaaatcaaacatgatcttcaaaacccatcaaaagcgacgcacgaagacttattcggccgcgggattacgtatctctgcatcggcttcgtcagcttgctggttatctcaattctgtacttcattaccacccgtgggttagcgaccttcacaacgaaccatgtcagtttatggaaattcttatctggcaccaactggaatccggccctactggacaaacacggtaatccccagatcggtgcgctcccaatgatcgtcacttcgtttagtgtcacggtactcgccgcagtagttgcaaccccatttgcactgggggtggccttattcatgaccgaaattgcgccggagcggggaaccaaaattctccaaccggtcatcgaactgttagtgggaattccttcagttgtctacgggttcatcgggctttcagttatcgtgccactgatccgtcactcatttggcggcactggttttgggattcttgccggaaccttggtcctgttcgtcatggtgctaccaaccattacgtcactttcagttgacagtattaaagctgtgccgatgttttatcggtctgcgtcattggcgttaggagctaccagatggcaaaccatttataaagtggtgctgcgatcagccactccaggaattttaaccgccgtcatcttcgggatgtcacgggcatttggtgaagccctggccgttcaaatggttattggtaacgctgttctcatgcctcatggcttattaacaccatcgtcaactttaaccagtcaattaacgaccggaatcggaaacaccacgatggggaccctgccaaataacgctttatggtcactagctttgattctgctattgatgtcattagtctttaacatcttagtcagagtaatcggaaagcgagggagcctgaaaaaatgaattctaaaacgagtaataacattgccactggtgtaatttattttctggttgcctgtgttttggcgattctggtcttcctgctcggctatatcttgattactgggattccccatgtatcatggcacttcctaacgtcggcagcacaatcgttcgctgctggcggcggcattcgggatcaattgttcaactcgatgtacctgttggtcctcacgttgatcatttcgtttccaattgccttgggttctgggatttatctttcagaatacgcccctgacaactgggtaaccggcgtaattcgaactgccgttgaagtattgagctcattgccatcagttgttgttgggttgtttggcttcctattgtttgtggttaatttccacatgggcttctcaattttagctggggcgattgccctgacattcttcaacttaccgcttttaaccagaagtattgaggaatcactccaggatgtttccgaattacagcgtgaggcggggctatcactgggtttatcacgttggaaaaccatcaccgggattgttttgccagccgcattgcctggtattttgaccggaattattttaagtgccggccgggtattcggtgaagccgctgccttgatttataccgctggacaaagtgcgccgacggttaattacggtgactggaatccgatggacagtgccagtttcctgaactttatgcgcccagccgaaaccttagcggtgcatatttggaaggtgaacactgagggggttacccctgatgcggcttccatttcaagtggggcatcagccgtattgatcgttgtgattttactgttcaacctattggcccgcatgctgggacgttggttgtacaaacgcatgacagcaacgaagtaggagattattatgcaagaatatgactataataaaacgcacattatcgatattccgttagaaaaagcgatgaccaccgaaaacctgcaggtgttttatggtgacaaccacgccatgcacgacgccaccttacaatttccccgacatcgcattaccgctttgattggggcttccggatccggtaaatcgacctatttacgctgtctgaaccggatgaacgaccggattgcgaccgttcaaggaaaaattatgtatcgggatatggatattaattcaaaaaagattaacgtctatgaagttcgcaagcatatcagtatggtgtttcagcgtcccaatccgtttgccaaatcgattcgtgaaaatatcacctttgctctcaaacgcaatggtatcaaggacaagcaagagcttaataaacgcgttgaggaaagcctgaaggccgccgctctttgggatgaggttaaagatgatcttgataaaagtgccttggccttatcaggcggtcaggctcagcggctttgtatcgccagatgtgttgcaatgaagccggatatcctcctcttagacgaaccggcaagtgcgctggatccaatttccactgccaaaattgaggacaccttaatggaacttcgcaagaattactccattattattgtgacccataatatgcaacaggcgtcacgaatcgcggactacaccgcattcttccacatgggccatgttctggaatacgacgtgactgagaaaatatttacgacaccacaaataaaggcaaccgaagattatatctccgggaacttcggttaggaggctgaacaatgccaaaaatcattatgagtaaagatgtccatttaagttatggacccaaagaggcgctccatggcattagtttggactttgaagaacacgatatcacagctttaatcggcccatccggctgtgggaagtcgacttatctgcgttgtctcaatcggatgaacgatttaattaaaggggtcacgattaccggatcgatgaagcttgaagacgaagatatttacgcccccggaacagacattgttgacctgcgaaagcgggttggcatggtgttccaacagcccaatccgttcccattcagcgtctatgaaaatgtcgcttatggactgcggctggctggtgagaaggataagcacgttttggatgagcgggttgaaaccagcttgaagcaggcagcgatctgggatgaggtcaaagaccacctttacgataatgccctgtcattttcaggtggtcagcagcagcgaatctgtgttgccagagtgctggcagttcagcccgaagtggtgctgttggatgagccaacgtccgctctggatccaatttcaagtgccaaaattgaggatactttgttaaatatccgcaaccaatacaccatcatcatcgtgacccataacatgcagcaggcctcacgaatttcagataagaccgcctttctcttgaacggcgatctggtcgaattcagcaagaccgagaagatgtttattcaccccgatgatgagaagaccagcgattatttgaacggaaagtttggctaggaggaatagagacgatgagagaattatttgacgacgagttaaaaaagctccacggccggtttgtggaaatgggcctgacaatcagtgaacaaatttataaatcaactacggcatttattgagcatgataaaaaagccgcccaagaagtcatcgatgccgacgaggaaaccaattcagatgaaatgaaattggaaaaacaggctttgagcttgattgccttacaacagccggttgcgaccgactttcgggtaatcatcagtattttaaaagccagttctgatttggaacgaattggtgatcatgcggttagtatggctcgcgaaactattcgtgtaaaaggtaatccccggattcccaaggttgaaaaggccattgccaagatgaccgaagaagtccgagatatgttggagagtgcattggatgcttatgtgaagagcgatgccgacgccgctaaaaagttatccgacaatgacgtcaaagttgatgaacagtatctgttaattagggatgaaattaccgaggccgtgcaatcagataccgcaacgatcgcggccagctccagttactttatggtgattaaacttcttgaacgaattggtgatcacatcgtcaacctggcggagtggattgtttattcggctgccggccagattgtcgaactgaatcctggcaaatcaaatcctgagctggttgacaaactatactctgaggcaattgtgaaggataaagataagggcaaggattcttcgaaataagggatttaagttgagatgaaataaatccaaattaaaaggtcagggcatcattctggtgaatgatgttctgacctttttgcgtttcagtatttctgtttatcacaatcttacttggcaatcacaattcggccggcgtgcttggagtccagcagttgatggcccttaatgaccccgtcgagggtaaatggtagcttgtaaccgatacgaattttgagtttgcctgccgccatcagttttaacatggcattcaaagcatcatcatccgagatttcctgggttgggtgaatgtgattgaaatgaaccgttttatcggttggcgcatcgttgtcggcaacactggcgacaattccgtcatctttaacgattttgacgtcactttcggcgccgttgccgtttaatgcagcatcaatcacgacatcagctgtgtctgccaaaacttctgctggatcttcctggtcgtaagcaacgtattgatcaacgcccaatgatttgacatattcttcattttcgctggaaccgatgccgatgactttggcaccaacatccatggcaatttgggcggcaagtgagccaaccccgccagaagcccccttcacgacaacggtttggccggcttgaactttgccaaacaggtgaacacctttataagcggccagaccgggagtcacaatcccagctgcggctagatagggaacaccactggggattaagacggtattggaatcctcgccaattgaatattcagcgtaggaatgatggccgtgagcgacaacccgatcaccaatatcaaaaccagtgacatcttcgccaactttttcaacaaagccggccacgtctcttccggggatgattcggtggtcgactggtttgaattgaccagctcgctgtaatgcttcaaagttatttaagttgaaggcttccgttttgattaagatctgattggatttgatttcgggggttgggacttcatactcctgaaacacctcgggaccgccatttttttcgtaaccgaatgctttcatcaaaatcgctcctttgtttgtatttatacaaactcagtgtaattcatatgcatgtgaaagcaattaatttgaattagagttgtctggttcggcagttcttttcatcagcgcctcattagtgtaattaatagggcattttttgtttgtcggtcaagtgacgggttggcatgggaaaattcctttcttttgagagatgatttattcattatcccctctcttaaaagttgtctctgggatcagcttacatccagtaaaggccattcatctttctgtaaccaaatttgtcaaaataatcgctgcaacaaccgcaatgattacaagaaatagaccaattaaaatggaccaccctgatccagaataaactgcatttgacgggaagtttgccaaataaatcatgaaactgcaattaatcgcaaattgaatcaaccatagtatcttcttgtgcatacttcatttctcctatcatcaataagaaaagtcctcaacaatttgtatctgttggggcttgggtgttcatcctatcaggactttttggcactttgactatatcatatcagggggaaatgccccctaacaatcattacacgcattaaaaaaagttacgtatttgggtcaatgaaacatccatacgaagcaactgttgtccttaagtatctccttatttggttccaatcacaaacccttgatgcatattgccagtgtcatattgatcggaccactggaagttagtcaggtagatgccgatgacgtattccttttgacgtttagcagcagtatagccgttagccactagaattgccttaatttttgctaaccgctgctggttggttaaccggtttttgacattcaaaaagtcatccattgccttgaaagtagctacattattaacaatcttatccttaggttcacgaaacaacgcataccgacttaatggcttggaaacggtactattgggaaacagtgataaaatatcacgcgttaactgatggtatttggattgaagtcaatatttgagacagattttaagggacattcagaacggcgtttaagtgtgtgatggatttaacatatcgcgaatgcaaggcgccaaactagtctcctgccttcgtcgacgaatgcgccttaatggcccggttaatcaaaaatagcgaaccaagcgaaagaactgcaaaaacaaccgatccaatactgattctatccaggccaacaatgcccactaaactcgaagccgtcgcggatcccagggaaataccaaaattgaagaaaattgaactcagggatgatgcaaagaccagcgactgtgggtattctgattctgccagatttaggaaatgaatttgaaccggtgaattgatgattgtcacaatcaatgtcaggatcagcatgatggccagaccgacaattttactgtgtaatgcaaatggaaaaactgccagtaagaggatatcgacaacgtaaaagagcggtaccttttgcaggctgtttggtttttcggccagcattcctgatagccgattactgatgatactcataatcccgatgatgaacaacagccagttcaaactctgggtactgaagcccatcgacgtggtgagcagcgggcgaatatatgtgtagtagccgtacatggttgcggccgtgaataagaccaggaagacaccgtaatagattcggggatccaataaaattgtcagctgatttttgatggtgctggttgtctgcttaactttctttggcaggatttgtgttaacaatataaaggtcagaatgctaataaccgaaattccccagaaggtgtaacgccaaccgaagcttgtgctgacggcaacgccgattggcaccccaaagactgacgcaatgctgaagccggcaaagatccaagaaaccagtgaagcccgtttgtcccgtggtgcaattgtgctggcgaaagtcatgatcagtgaaatgattgacccggctgtcgttgcggtgatgattctggaggccatcatggttaggtagccaattgaaagggcactgagtgtgttaccaatcaaaaagacaatcattagggttaacagggttttatagcgactgtaccgacttgttaggattgtgacaaatggtgtactgacggcgtaaaccatcgcgaagatggtgaccaagtaacccatggttgagattggcgtgtgaaattgggccgataaatccggcagaatcccgacaacaatgaattcgttgcaccccaacataaaggcaacgaggatgaatactaatgattgaactttatacttagtcacttgcagaccctccaatggtcaaattgtttcatgtgaaacttcctctcaaatcatagcacaagcaaccacagtgtgtggttataatcccaagttaagacagattttttgatagatgttgtctgtccatggaaatggtaatgaaaacgtttgtagaggtgctttcaggcaagaaattctgtcaatcttcttgcatctgtgacgaaaacttgtagaatggttcgaagtgactattttgaggaggatatgcatttgtttatcacaacgattaaaaagacccaaaaaggatttctcggattcattaacttattggctgatatctttgttccaatcattcccgcaatcgtggcggctggtttgctaatggcacttcacaatgttttagtggcgccccacctatttatgactgcttctttagttgctgcataccctcagtttaaaggatttgcggcgtttattaatgtcttggctaacgcaccgttcgcatttttaccggtcttaattggattctcagccaccaagcgctttggtgggaatccatacttaggagctgccatggggatgatgatggtgtcgcccgcccttgtaagtggctacgatgtgagcaatgcggttgccaatcattcacttggttattggcacattttggggatgccagtcgcccaagcaggctatcagggatccgtcattccaatgttggcggtggcctggctgctgtcagtcattgagaaacagtgccataaaagacttccagaagcacttgattatacatttgcaccactcattacgattttattgactggaattttgacctttatgattgttggcccagttatgcgggatgtcagcgatggcttaaccaacggtttattgtggttgtaccagacttcgggggcctttggaacaggcgtcttaggcttgttctatgcacctttggtcattacaggcctgcatcagagttttccagcaatcgagacccagctaattgctaacgtgaaacaaaccggtggcagtttcatttttccgattgcgtcagtatcaaatattgctcagggtgcttcggcactagcggttttctttttaactaaggataagcaacagcggggactggcgtcatcagctagtatgtccgctttgctgggaatcacggaaccggcaatgtttgggattaatcttaagttaaagttcccattcatcgcctcaatgatcggttcggctgtcgcctcagtttatttgggacttacccatgttttggcagtctcactaggctctaatagtgttttgggattcattagtattgcgaccaacgccatcccggcattcttgattagcatggtcattgcttttgtggttagtttctcattgacttacgtttatggtcgccgtcaagaagtgagcgacctgctgggtaaggatgacaaggatgctggcgaggcgattgtggctgactaatgagtgagcgagtagtcggcatcacataataagtagaataatgccccctcaattcagacggatatacaaaaattcaaaacgagcctcattacaacatccgattttacttcacttctcaaagccctggcttgctaatttaacggggtatcgattgtataatcgttcgtggttcatctcggctgggatcaaaggtgagcaggggctaattaattattgaaaatgattcatcgctaattaaagccaccagtggattgatcgtccattggtggctttttatggtttgctgcattcaagtatctttaactgttgctttcttctttcagcaaggttgaaagagctggttgatcaaacaaatttgattgcttggtataagtgtcaatggttgcttgatcgaattggtcgggatcgattggcatgaagctggtatcaactggatcctggttcttgaccttggcatcgattaagattggcttggtgttgccatttgcttggagttccttaattttttcgaatgcggccttcagcgactgccgatcggtgacttggatgccaatcgcacccatgtcgtcagcaaagccggcccaattggcaccaatgaagtggataccatatggttcctggcttgcagtgatcttttcatgctgaatgtaaccgaatgcgccgttttcaagaacgacattgatgattggcagctgatattgcacttgagtcagcagatcctgcatcaccattgagaagccaccgtcaccagaaatgctgaaaacctggcgatctgggtaactcaatttaccggcgatacttgctggtaaggcgtagcccatcgttccaaaccaagctgacatactgaacttttggtcctggttaaatggtaattggcggatagaccacattaagttgttaccaacgtcgaggccaaacaccgcgttgtcatcactattttccttgatggcccggataactgcttccggtgctaaaccatcatgttcatcgtcagcgactttattcaaccaggcatcccagttctgcttatccttttgagcagccttcaggaatggggttggggctattggttctttttcatttaatttggccaggaacggtttggcatcggctaaaacagtcaggtcaatgtcatgctgtttccctaaatcttcaacgttattgttgatttgaacaaatttgatccccttgggcaggaaacggctgaatgggtaattggttcctgccaggataattaagtcggctgcctgagttacctcaaagcccggcttggttcccagacgtccccgcgatcccataaagttgggatgatcggtcggcataaccccggttgccggagcggtggtgagcaccggcacactgaatcgttctgagaaggcaacgacttcatctcgagcatctttcaagccaaggcctgcccataagacgggatgctttgcttgtttgagtaaatcatagacttggtcgacagcgttttggtcaacattcacggtggtggccggttttaagactttggcagttttataaggttcaaaatcaatttcttcacccgatagattatccggaatgattacaactgccgggcccttggtccgataggcatagcgaatagcctcatccatcacgtagggaatttgttccggattggtgacttgtttatgaaaatcagttaagtcaacaaacaacggatcctggtccatttcttggaagaaataggtattcataattggcgttgctgattgacccacgattgcaaccacgggtgcatgatccatcttggcatcatataatccgttgaagagatgcgttgccccaggaccagcagagccaaagctgacaccgactttaccagtcaatttggcgtcggcggttgcggcgagggagccaacttcctcatggcgaacctgaatgtatttaattttgtcacgttcctgatagagaccgtcaacggtgttattgattgagtcagcggtgatcccgtacaaatggtcaatatcccagcttaccagtactttggccaaggcttgaccagctgtcatttttgccataaattaatcactcctaaatctaaagtgtaatgcttactttttataagtatgtttaaaaatataacgccttttgaaactgagtgcaaccatttggttcacaaactttgatttttttgcttagaaacacttgcaaataaaagaaaacgatttcagatactttgtgaaactttccttccggttgtgggaacctcatcaaatgacctaacgcttcgtttgatattgaactgtttgtcgtttctaacggactctcattgttagtcattattcaaaaatgtttcatagtagtttgccggcttgaagaagtaatccgaaacatcggcatcattactgtcaaaatgcttgacgattttagcattagcgttgtcagcagtggtgtatgaactggatcctgatgatttggtgatcattttggaaattgtgagggtgatcccgttccctttattgaaggccggtaaatttgtcgagagttcaaactgttcgtgccagtgaccattttcatagtgtgcctggatgaagccctcaccagtcattgtccgatagtaaggtgactgagttggattgatttggttgagcatttgctgaagatgggtacctgaaccaactccactttcaaagctgggagcaaagtaccagataccgtctttcaaggttggctgagtgttggaaagcttaaaaatatcattggtcggaacgtaatgcagccaacggttcaaatcaaccagggagagattatgattggggcccaagttgttgccgtaaatacgcgtgattgggccactgttgtaattagtgacttgagcacttggatcaggaaaatcaaaagcccggctccccagcggtaagacggttacttggctaacatcgtaattggcgattggcttggcgccgttgggcaattttgacaaatccaaaaccgccgcaaatggattgatttcttcccaattgccactgatggctgggccgttaagaatatcgatcatgggaacctttagccattgattggttccatagtaaactttccgcatcacaattcgcgcgccattatgctgaccatagttcaacatctcagggagataagaccagttttgctttagatatgtcagggcctgtttttgatcattgagggcaggggttgtcgcaaacggttttagctcattttgattaacagtcccatgaatacgattcgaagatgcatacacaccagaagcatcccattcgccgatccgactcataccgccacgacgatacggctggttggaaagcagtacgttgaaggtggggtagcgataaaagccacccttgtagtaggttcctttgatgagaaagccgtgccaaacatagcccttgatcttattgttggcattatgaatgtagtaataacttccaaaataatgattggtccgaatcgtgacccgcttggttgaatagaaatttgtccgcgggtaattttttaaattatgtaacttttgattgtatttggcattccaaacataggcgtttcggttggaattgatcaaaaatgatgttttcttgtaagactgattggttgtgatttttactttagcatccactgtggtcggtatttgcattgaaacaatggcggccgtcagtagagatccggttgcgattaaaagtgttagatgtttgttcaaagtcatcaccccttgccgacattatagagcagatgcacgcaggccgccaatctaacagaatgtttcatgtgaaacatcaacatttacccactttttacaaatattttgcgggtaatttacgtcatcccagtacactaaagttgaatcagaaatggctatcagggactatctaaaggatggtgtgatcatgtcaacaatgttatacgaaatcaaacatacccccaagttgggttgggaaatatcgtttgtggttttgctgatacttgttgttctgataatcgtttcatagaaattatttcatcttgggaggattaagcatgggaagtagacatagcagtacgatcttgaaaacggttctgaaaagcgcctttgtgctgacgttgaccggagctgcaattttgggtgctcaaggtaatgatgtgaaggtaaacgccaagtcggataccagtgtctcaaacgagttgaatccggttccagcttcatatgggtatttcgtcgatcactataaggagaatgtgaagaccaactcgactccggacaccaatccggcgatcgcgttgttcaacaatacctttttaagttattggaatccaactgacggtacaaagacgaatcaaaaagtgctccaagacaatttggacaaatcaattcaaattaccaacggtgcttcgcaagcagaaattgaccgttcatacttaactgaccggcgggacctgcgatataacctgattagtggttttggtccctacgctccggcatttatcaaggataccaacgctcagactgattttaatgccgttcccgatgcaccgcttcccgcaggttcaccctacagctcgatgcagtgggcagatgaaaactcaactctcggttccgcggttaagctggttgatattgcagaagattcagcatggtctggcacagggacgccaaaggcttacatcaaatatacccgtccttatcgtcaaagcgatcaagtcaaagttaacccatacttgaagaacgtaatggcttctgctgccgccaacgattatgatttcccaagcggccatacaaccgccgcatttgaaaccggtgaaaccttggcctacctgttcccagagcgctatcaacaattgattacccgttcttcggaagtcggctatgaccgagtacttgccggacgacactcaccgttagctgttatgggtggccgggtgatcggaacagcaatgacagctgcgaccttaaacgatccggacaacaagcagctgatcagccaagcctaccaggacacgcaaaaagatttggccaaggctcaggataaatcagccaaggacgactttagcgattaccaaaccaacctgaagaattacacctatcgattgacctatggcttctcaccaattggtgacaccactaagccaatggttgtcccaaagggcgctgaagtcctcttacaaaccagattaccatatctaaatgctactcaaagacgtgaagtcctctacaccactggtattccatcaggttacccaatgactgatgatactgaaggttggggccgtttgaacctctttgaagctgctaacggttttggatccttcttggacaacgtcaccgtgaacatggatgcttccaaaggcggctttaacgcagccgacacttggaagaataacatttccggtaagggcggcttgactaaggaaggttcaggatccctgagcttgcttggaaataactcgtacaagggcggtaccactgtcaaagcaggaaccctggcagctgaaaatgacaacgccttgggtgacggcagtttgactttagcgggtggtaacttaaccctctctgccaagaatgttgtggtcaaaggtaattacacgcaaagtggcaaaggcagcttgaacctcaactctggcgacaaggtttccgtatccggtactgctaaactaggcggtaaactggtagtgaaagatgtgaaaggtcttaaatccggagtggttattcttaaatccaacaaattatccggtaaatttgcccatcaatcattgccaaaaggttggcatttagcctataccacccataacgtaaaattagttaaataaaactggttgacatcgatcagaaatcgtattagtatttgtgtcaatcagaaacattagaatttgctaagacaaggagagtagtctcttagaactttttcagggagaatcgggtaagtgagaacgattcaaaagcctaagcgatgaaagtagccttcgagcgacaaatgcgagcgagtctgcgagtgtttgttgggagcgcccattacagcgccagtgtatcgctgaattcgttcggccgtacatggtgagtcgatagttgtgaagctgtcgagaatttgggtggtaacacgtgcaaacgtcccttaagatcgtatcgatcttaagggacgttttttatttgcaattaaggaggtcttcaaaatgagaatcatgttaaatcgaagcaagtcaggcggcatcagtcgagtcaccaacaatcagcataaaataatgggaattttagcgtatataaattatgaggagcgcttaatatggaaaataatacaaagaaattatcatttaaacattatctaattattggttcaatgttgtttgggatgttcttcggtgccggtaacttgattttcccaattcacttgggacaattagctagtgctcactggatgtctgctggaatcgggtttctgttaactggaacattattgcctttacttgctattattgcgattgcagttactcacagtaacggaatttatgatctcgccaaaccaatcggcagccgctatgcgactttcttcatggtattggtttgtgcgacccttggacccttatttgcgacaccccggacggcgacaaccccatttcaaattgcctttgccagccatttgaatccaacgcaacaaccaatgtggctgttgatttactcactgattttctttgggatcaccttctgggcatcacgtaaacccactggaattattaactcaattggaaaaattttgaacccggcattcttagcattacttgcgatcattttcgcgtttgcattcatgagcccaatcagctcagcttcaaaggccccaattacggatgccgcttatcaaaatggttcgattctcaacggtttcctgcaaggttataacacgatggattgtatcgccgggttactcttcgggatcgctatcgttaccgccattaagagcttgggcgccactagtgccaaagaaatttcaatgaccactatgaaatctggtgccttgggcatcgggcttgaagccattatttatatcgcgttgatctggttgggtgctaccagccttggtagttttaagttatccattgatggtgggattgcctttaaccagattgccaatcatttcatgggtatcaccggtgaaattctcttggcaatgatggccaccttgacatgtttgacaactgctgttggactctcgacttcattctcagaagcattgcatgctaaattcccatcaatttcttatcgaacttggttaatcatcgccaccggaatgtcgtttggaattgccaactttggccttgatacaattattgcctggtcaacaccaatgctgatgttcctctacccacttgccattaccctgattattctctcaattgcctcaccattattcaatcatgaccgtcgggtatacatctggacgaccatctttaccattatcccagcgattttggatgcgatcgccgcagctccggcaattatttccaagtctgcatttgctagcacaattttgaaattagatgactttcttcctggcgcttcacttgggatggactggttgttgccagccgccatcggactaatcattggcttagccattcactatattggtgccatgatgggcgctaaaacaactcagatcgaaaacgactaatttgtcgacacatattcacatagaacctaaaacacatataatagattatacacacataagtatcatgagaaaggaggtcatgacatggcgtttatcggtgccctgtgtctgttactgatattgacgacactggctgggcacttggcgaatcgaattgggattccgtcggttatcggccagatcctggttggaattgttgtcggtccggccatgctgggctggattcatttggataatttgattaatctgttttcccagattggtgtcattatcttgatgtttatcggtgggctggaaagtaatctgaaattactgcgaaaatatttgcgaccggcaattatcgttgcgattattggggtcatcttccccgtgatcatgattggcggggcctgctgggcattctcgttctcgccacttgaagccatctttatcggcgtcgtcttcagcgcgacgagcgtctcaatctccgttgaagtattgcgggattataagtccttggataccaaagagggagcgacgattcttggtgctgcggttgccgatgacattatcggcgtcattctcctgtcgattatgattagcgtgatggggactgccggtgttaaaaccggtgattcatcctccaatcttgctttgatttttatcgagcaaattgccttttttgccctaacctatttgatggtcaagtggattgttccttatctgatgcagattggcgagcgcctgctcatggcctccagcgtcacgattacctcgatggtcatttgtttgggaatggcgtatatcgctgaagccgttggcctgagcggtgccgttggtgctttctttgccggcatcgccgttgcccataccccttatcgagagacgattgagaatcacatggaaccgattggctacgcggtattcgtgccaatgttctttgtcagtatcgggttaaacatgtcgttcgcaaatatcggcaactcactgttatttgtcggtgtcttgacctttctggcctgtatcagtaaactatttggctgcgggctgggcgcaattatcaacggctttaacctcaacagtagttacatgattggttcggggatgatttctcgaggcgagatggggttgattaccgctcaaatcggtttctcctctggactactgtcggattcgtattattcagatttgattctggtcattattttgtcaacgctgatcgcgccgttcctgttgaaacatgcaattcatctgttgcctgccgatgacaaagctgatttgtcgttgccggtagaaaatggtgtgccgagtgatcattagttggctgatttgattcattttcattttaaagaatatcaactaaaataaggaagtgagccatcaggatgttcctgatgtttcacttcctttttgagttgtctttctacatatcattaaagaacttttttctcggtatatttttgctcgaggttgttgaaatcgtaatccttgagagtttgaatatcgtctttgccgttaaagaaggcggtgtagctgcgggccaacattaggtttaattgaccattttcaccaaattggaccatgatgactggaatgttggcctcgtgggctgagccgatttcaaagattgtgcctgaatcaggttccgttaagccttcttccagttgataatccaaaatagcaacgacgacatccgctttatgtacttggcgcatatcggatgcgaagacggcgtcctgccatttgaagctgccgaagggttcggattcgaattggtggtcttggggaatgaatatgccgtcagcatcgatggttgggttctgcttgagtaaggcaaccacttgggcgatgcgatctttttgaccatcactgaaaaatggggatgcaaggtagactttgtttttgtaggttgacatgggaaatcctccttatttttaagtcaattgtacatgaaaacgggacaaaagtccgcaagatcctgtggtttagcggattaactgattctccttggtattttgaatcctccgaagttaattgaaatggttcgtccataacattacaatgaacatatggaaatgcggattattttgggggaatgtttatatggtaaaagacagaaatgataatttaacagttcgtcgtttgaaatgggtgattgtcggactagtgtgcttgacttttggtttaatcgccggctttaacggtgttgctaaagctgctgcgggtgacacttatacgcctgttgacaacagtgttctaaagtacaagcaaaacttttcaaataacgataccttatattcaggcaatagtgtccaatttcagttatcgttgaatgttccgggacagcagaagcagcgactgcagaagggtgatgagttcgtgttgaacttttcagctcctattttcagtaccaattctgatgccgttacgttcgagttaccgacagataccagtgcaacgtcatggctaacaaaagatgactttgaattgagtcattcgggcaatcaaattatcttaaaggtcaacacagatgatgctgccaagttaaacataattcagcagatgaccgctgtggtcaatggggttattaacacgtctacagatttaaatggcgttaaagtaactccttcctttaagttgaatagtgatccgggtcacccaattaattttgatccaaccacaatcaatatctcgagtagttcagacaatgggggtggaccaaacccacagtttaaaatgtcacaagcgctattcaatggctttgccaatttgaccaacaatatcactaacaatgggtgggtcaacaatgctgccggattgtcggttggaactgatgaaacgactctgaattattatcactatcaggatgcaatgagtgtcacggggcaagtcaagtttccagttgctgataatatgcctgattcaatcgattgggtaattaaaccggctgatggcgataatcacaagattgatccttctggtgttcaagtttgggctgattcttattcaaagaccaatcagcctgcacaatattatcaaattccttcgggtgattatacgctcaaacaagcttctgacggcaaagggattgaactgacgcgccttaatcagaaatatttcaagcccggctggacaatcaacgtgttgttctatattgtaacgacaaagaccgtctatagtttgacgggtgacggggtcaatggtgccaaagacacggttcatctggtgtcacatgttgctactactggtggtaatccaggagtgattgctgatcacaaggcattcttaaaatacctgaaccctgacagcgttggttacaccccacagttaaaagttaagcctgaaaaaacatttgacctggcgaagactgaccaagacggctttattgctggggatgttacgtcgcaggccttcattcgccaatttgtgcaagccgcttatgataattattataatgtggccgatcaatcaaaagatatcgctaaaggctatacattcaaggcggcatatgcaaatggatcgccagtacttgatccacagtcccctgcggcgggtgactatactttgaatattaccgcggtaaacaaagatggcaatgaatcagcaacaattccagccaaattccacattatcaataatgccaacccaagcgaatctaaaaatattaatgtttcctatgtagatgtcaatgccccaagcaccagtttggatagtttcatactgttggggaattctcacacactgaactcaaccagtgatattgggagtcagatcataagtaacattcctagtggttatcattatgcaaatgccagcgaattaaaatctggccaagcccagccaagtaatacggttacttggacgaatcaggcgcaaaaattgactgtctatgttgccaaggacacgacacccaccccaacgccaacgccgaaaccgacgcccaccccaacaccaaatccaaatccaaatccaaatccgtccccgacgccaactccaacaccgacgcccacgccaagcccgacacccgcaccaagcccgacacccgcaccaaaagggaccgttgtgtacgcgttaaagaaaatttatctctaccaaaatacgacgtttagtactcatgaacgccgagcaggttacgtttccaagccgcgcgtttaccggccgatgtttgttgtcactggatacggtcattccgcaaatggtcgccttcgttaccaggttcgcgatgtgaaccacttaactaagaatcgtggcaagacaggttatatcaccgcacagtgggcatacgttcgtccagtttattatcagacgatgcactcaaccgtgacggttattaatccgcgcggggtcaatgcctatatgtacaagaatttgactgccaagaccagaaactacaaacaaggcacggttcttcatgttaccaaaattgttaagcacaatttgacaacccgattcgtactgacaaacggccaatacattaccgcgaaccggaaactggtcaccatggataaacaagcacaaccccggtatatcaaagttaaaaaagcaatctaccgttatcgagatgtgaacttgagtaagcgcaatcgtcacacttccttcaagaagggcaccaagattaagatcaagaactacgattactcacatgcaaacagtgtctctaatcatggcgctttgaggtatcacgttgccggcgggtacattaccggaaatacgaaatatgtgaagattgtcaaataacatgaaatcaaaaatggtattccaccttggaatgccatttttgttttacaataaagattaaaagaaccttgatagggagtggaccaacaatgattgagcatgttcaaggaatgaaaggcgaaaaactaaatcaaattgaccaaatctggttggatgccaatctggacgcccattcgtttatcaatccaacttactggaccaactattacgatggggtgaaacgagaacttgccaaagccgaactgtttatttacacggaggacggtcaaattcagggtttcttgggaatagaagggaactacatcgccggattgtttgtcgccaagcagtaccgcggtcaggggattgggtcacatctacttagtgctgccaaacaaacccgctccgaattaacgctggcagtctatgagaaaaattcgcgtgcctatcacttttacattaaagaaggttttcaagaagaaaaccacgaactcgatcaggttaccgatgagtttgcggttaatatgaaatggacaaaggatggaggtgtcaaagatggcagacagtaaagttcaaccaagaatgggaaataccggttttatcatctttttggccctgctcagtgccttcgtgccgctttcaaccgacttgtatttacccgcacttccggagatgaccaagttctttgcggttcccgaaattgtgatgaacctgactttaattctattttttgtgttttattcgatcgccactttattctgggggccgttaagtgatcgatatggtcgtcgaccgattttattggttggcttgaccttgtacatgttagctagtatcctctgtggcattgcgaccaatgcctatgaaatcattttcttccggattcttcaggccattggtggtggagttgcgacgacggttgccacggcggtcatcaaagatgtctttgttggtcgaaaacaggaaacgacgttggccatcgttcagtcgatggtggtcatttcacctgcggtcgcaccggtgattgggtcgttactgttgacgtttatttcctggcgggggatctttttcgcccaggcattgctgggactctcagtgatttatggttcgattatttttaaggaaactcatgcttcagaacgtgggactaccagcgtcatgaaatcatttggccggttaggtgcactgctgattaatcccggttttacggcacttctggtcactttttcactcatgtcgattgtgtcattatcctatatttcctcatcttcctacattttccaaaatacgttccacctcagcagccggatgtttagcctgttcttctcgtttaacgcaattggcatgctgctggggccactggtctatattccgctttccaagtatattgaccggtttacgattgtctatacagcttttgggttcacgatcgttgccggcatcctagtcatggttttcggccggatgtcaccgatcgcctttgccttaacccaatttccagcaaccctggccagcagtgcggtccggccacccggaacttatttggtattgaaacaagaggaaaacgataatggatccgcctctgccctgtacagtgccggtggaaccattttcgggagtgttggcatggtgattgtgtctttggccgaatcgacgccagtggccgcaattgcctggattaatatcgtgatggggggtaatttgcgcttcgctgctgttgctgtcgatgacctttttgagaaagaagattgtggtttaagattcattcacgcttgctgtgtaacttaaaaattcaaagacagaatgttcgcaaaaaataggagcccggaacaagagtgttgttctggactcctattttaaatatttcatgaacttgttttaagtggttttacttcaatactttaatggtggctgtcttgttgccaaagacagtttgactaatttgatcagagttcatattcagagacttggaagcattcttaggggttgaggtcaacttaagattcatgccctttttgagtttgttcaaagtggctttacttaacttaaacacaaagtttccgtttgagtttgcgttggttttcttcaaggttgatccctttgtgttttgcaagaccagtgacgccccggtggaagtagaaccggaaaccttgttcttgttcaaataaaacttgttgaccttgagggtgttctttggaagttgctgcaaagctgctcccttgttgatggtataaaggatggtcttgtcggtgacatttgatgggaaatagaattgaccattcttataagtcaccttcatggttgcttcatttccccaattaacgaaaccaggaaccgtatagttcttttgagtggacaaccactccggaattgacattccagaactaaccactaagacgttaccgccggttttttcagccttttgggcgatataagtcaactcggtgttcattcgatcgattacttgagttgagctttctgctttcaatgattcaggaagagttgggtcgctgtatttaccaaagtcgaccgtttcggcagcgtggtacgcatcttgaagtgccggccagaagtctttaccaagcgcttgttgagctttgccaaagtcttgtgggcctgaataagtaccggctggtttcaacagcggcatggtgattttgttgacgtcatcgtatttttgcccctcgaaactaccatagccgccttcacgtaaattggcagtccagttaactttcaggttgccgttaccagatgactgcaaggcataggttgctgtccggaatgtccgcatgttatcagcagaataggcagccttgaacttcaagccataaaggccgtaacccagttgatgggcaacggaaaccccggtatccgttagcggactgtcagcccagccttgtccccgtccgttgacgttgaacatggtctgaccatgacgggttaaataaatgttaactgtcttggcggaaacagtttgcgaagatgtccccaccccaatactaagtgccccggcaaataaaagtgcaaaccaaaaatgtgatttcttcatgattgacccctcctaaaagtatgaacaaatatacctaaattttatcattaaagccttgtaaacgataccaatatttgaaaatatttttagattgttcggctgtagatttgatatgatattaggtatggagggtcttatgaaaaaattctggaaaacacttttactgattggttccggtctattactcgttgtcggtgcatatgtggcatacgtttatctgacgtatcaccgggtgcccgacaacgttaaactcaaaccggttaaccggaactcgcaaattttacagacaaatcacccctacaaggcgatgacctttaatattggctatgccgcctatccggataattattctttcttcatggatggcggcaaatattcgcgggcatttagtaaattctctgtcttgaatgacctcaacggcatttatcaagctgtcaaacaagaagatccggccttgatgttcttccaagaagtcgataccgacggtgaccgttcatttcacgtgaatgaagtccagtggctaagggatcggatgaatggttattcgagcgtctatgcccaaaactataattcggcctacctgttttatccgctcacccggccaatcgggaaagccaaatcgggattgttgacccttgctcaagctaagattgcagatagtacccgataccagctgccaattgataccgattttaataaattcatggacttggaccgggcaatttcggtgacccatatcccagtggccaatgggcatcagttggcggttatcaacctacatctctcagcctttaccaagaatgccaaggtaagaaaagctcagatcaataagttattcgccaaaatgactactgagcagcaggcaggcaactacgtcattgttgccggagactataaccatgatatgttgggtaatagcccggccgtctttgaaacgaccagtaaaccgatgaattggacgcacccgttcccggctgatcaattgccaaaaggatttagaattgccaagcagggattagcccaggcaaaagtgccttcagtgcgggcaaatgggacaccgtatcatccaggaaagacctttacgtcgataattgatggcttcatcgtttcagacaacgtgcaggttaatcgggttcatgtcaaatcgttagggttcaaaaattctgatcataatccggaagtcatggattttaaactaaaataaccaatcagatatggaatactgcagatttgatgtcataatgaatttaagtgcggacggcacttttgaatcctaatgattgggggaatcaatatagggatttttcacgttggcgattttatctttgtcgtgattacttttatcatcgtcattgcgatcgcagtcgtcctagtatactttggggtgaaagcatataaagcctttatgaggcatggtcaataagaatggatataaaaaaggcacgaatctcaaattgggattcgtgccttttgctttattgaataatgctattttaccagccaattttacctgtatccttgggaatggtaacctcaccattttcaactgcggtaaacgcgtcgtcaagcacttgaagcgcttggtcgagttgctctcttggaatgaccaacggcggctggaaacgcagaatattgcctgccaaagtgatgataacgacgccgtgtgcaaaggcatagtagatcactttggtggcagcgtcactgtcgggttccttggtcttaggatccttgaccaattcgattccaccattgaggccccacattcggacatcaccaatcatgggatggcgttgctgcatctctaagaaacgttgtttggcgtatgcaccatcggtggccgatttttcaaccaagccttcatcttcgatcacatccaaggtagccagcgaagctgcggaacaaaccggattgccggcagtggtaaacaggtgcgcaggtgcatccaaactctgcatgacctctttcttaccaatcactgcactaaggggcattccagacgccagcgacttaccgacagacattaaatcaggttcgatgtctttgaattgttggattgcccacatcttaccggtccggccgagtccttgattgacttcatcaatcgcaaacaggatcccgtgttcatgacagaatttataaactaactgcatatattcttcaggggctttgatgatgccgccatcgccttgaattggttcaatcaagacacacgcagtttcatcagcgggtaagaatgattcgaatggcttcttgaattcgttaaaataccttagtgaaacgtcgtgctcggtttctcccggataggttcgatatgaatctggatacggaacgtgcaccacgcttggaagcattggcccaattttacgtgtcatgttaagactacttcctgataaggtttgcgaaccataagttgacccatgataggaacccatataggaaacaatgtattgacggccagtataggctctcgcaaacttgataattgcatcgtttgcgtctgagccggagttaccgaaactaaccattttcggtgaatttcccggcgcaattttcgctaacttttcggaaagttccattccaggaacatggtgaaaataagcgggagtgtaatgaattaatttttgagcttgatcggcgatcgcctttacgactttttcatgggtgtggccaacgttaattgcagatgcgcttgccagcaaatcaatgtatttattgccgtcgacatccactaaggttgccccgtgtgcgtggtcaattaccagattgtagtaattgatgcgcgccgaacgtgcataatacttgttttcttcatcaattaatttagacgctttgtataatttacccatgaaatcaccaacctttacaaatctttttcgtgttcagcttttttatcaattgttgcagtagagtgattcattccatatgcgaagtaaatgaccattcccaaaatgaaccagcacaatgcgtacgtttttgcctgaatatccaagccccagaaaatacccagagcgcctaagaatcctagtgccggtaatactgggtatagcggcatcttgaaacttggcattggaatatcttttccttcacgtgggcgaagtgagtagacacctaatgaaacgaacatgaaggcaatcagagttccggctgaaatcagttgagccaagaaagtgaatgggaagaaggcgcccaatgcgatggcgatgatcgtcaaaacgatcaatgcccggttaggcaaattgttatccagtttgccaagccacttcggcagcaagccgtcacgaccaaatgaatagatcaaacgtgatccggcaagcatcattccaatgagggcggtaaacataccgacaaccgcgatcgcttggacgactgtggcaaccagtgcgtgaccactttgacgaagtgcccagccaactggttcggcgttatttgcgtaatctgagtatttaaacatgccgacaaggaccaaagcaacagagatgaacaacacaaccgcgataaccagggaaccaagaatgcctcgtggcatagtcttttgaggattctttgcttcagctgagttggcagcgatggaatcaaacccgatgtaagccaggaagatctcggaaacaccggcatagattccttgccagccaccgaatgcagaaccgtcagcgttgacatggtacttaggaataaatggcgtgtaattagctgacttgatggcagtcgcaccaacgaaaataaagactaaaatggcaatcacttttaaaataaccaacgtattttctactcgggcggtctgagaagcaccacgcgagagtaatgaggtaactaagataatgacgatgatggcgactaaatccatcaagccgccgttgtttccggttgaagcagttgagagtgcctttggtaggttgaatcctaatggcgaaatcaacccctggaaattggcggaaagcccggaagccacgaaggccacggcgatgaaatactcggctagcagtgcccagccggcaatccagccccagaactctccgaaaacaacgttaatccatgaataagcagatccggcaaatggcattgcagcggccatttccgcgtaagcaaaggcgacaatcccggcaacgatcgcagctgccaagaacgaaagggcaacggctggaccagcatgttgagcggcaacaacgccgggcaaggtaaagatggaagttgaaacaatcgtcccgacgccaagtgccaggaaatctttagtggttaagcttcgaattaaatgagaatccttatcttgatacacaagcggatcttcttttcgaaacattttttcggttatactactcatacaatcactcctaatctctctatgaaatatccgcgctaaacgaaaactttgcgtaatgacaaaccaagtcctgtggaaaccacactttgtaaatacgaaaacgattgcggtttccttcctcgatcaacaaatatgtagataaatcggcgaattcgcattcagcatgcgagtagtttaccgcattttttattagattgtcaacataaaatctaattaaaatctcattttaaaaggatgtttgttataataaattagctggaatacccagaattcatttgccgaacggcttgttaatcactataatgatgatgtgtgactgcaaacaccctgtttgcaaactatattatttatgttgggggcgacattatggaactgactatcaaagagttggcggacgaattatcggtatcgaaaactgcaattagaaaacatatggacgataagttcagagatacatatacgataaaaaagggaaacaagattctgatcaaagatgagggtgttgaagttctcaaaggccaattcaagaaccaagttgaaactgctgacaagcagtcaacgaaaaccgctaaccagttagcagttaagagcgatgatcagcaaaccgcattgctggctgaacagcttgaggaccaacgcaaacaaattgatgccaaagacaaacaaatcgcagaattgcatcaattattggaccaatcacagcggctgcagctggatgttcaaaataagcttaagcagcttgaaagcaaaaacacttcttcaattaagcaaaccattcccgaatcagtaaatgaagaagagcctcaaggtgataagattcctgacagctaccagccgagtaatgcgcgatttcaagaagccggcaagaaaaagcactggtggcagtttggcagatagaattttcaattcattttttgaataagattcatcattcatggagatatcggtatcgaccgaatggaccagctattatacagaaagccggggcataactacctgttagttatgtcccggttttttacgtcccattttatcagctaatcattaactcatcattattaaaatatgctacattaaagttaaaatttactcacgtagtagaaagtctgccgactggcggttaaaagggggagaagccaatgtcaattcagacgattttacaaaacagatatgctgacattgaggttgaatgggttcgttatttgaataatccgttcgatcccgagcgggcgcatgatttgcgggtcatgattcgtaccttacggggattaattaaattcttgaagcgacggctgacccctgcaacttataccactatcgataccaatctcagtcaggcagccaatttgtttggcgatttgcgggaacttgacgtcttgattgaagagacaggcacctacgcatacgctcatccagataagaaggccgactatcaaggcttgctgaagattttacgcgataatcggcaacatgaaatggcacaaaccttaaccgaggggacacaggcaaccttaaaaaaggatttggaaagtgtccagcagcagttaacccagcttaagttcacccaaaccactgcatggcaccaatatattgtcaaggagctcaatcgtagaaatcacaaactagttgccctattcgagaaactcgattttaaggactacccggaagttcatcatgttcggaaacgctcgaaaactttacggtatgcgtcaacctactttgccgattttgcgcccaacaaggccaataaaagtgccaagttggccaaagatattcaagatgacaccggcacaatcaccgatgcccatgtgaactatatgaggctgcgtaaattggcggatcagttgagtaaaaatgctgataaacagttactgagaaaaattgccgacgatcaactcaagaagtttgaataaccaacaaaggagaagcagatggcaatattgactttgacccgagcttggatccgattagaggaacagacaacgattcatgtaattctgccaaatgagattcaaagtgaccgaaaactccaagtgctttggctgctgcatggcttgggcgataatggcagtgggtttattcgtaaaactaatttggaagtattgaccaaatatacgaatttagcggtcatcacacctgaaatgaatcgtagcttctacatgaatttgcacaatggcctgccgtactgggattatttgaccaagcaagtgacgccggaaatgcggaaactactcccgttgtccagtgaccgacaggataacttcgttggcggcacatcaatgggcgggtttggagcactaaaattggctttcacccatcctgagtggttcagtgccgtgatgccgatgtcaccggtagttgatttgagcgaattgccagcgatgatgccggatgcccaggggattcttgagagaatcgcgccagagcactatttggaaacattagctgaaaagtcgccatctgaacagctgaggcaacttcgcttcttctactgtattggcgaccaagatgaactaaagccaaccaatgatcgattcgttcagtacatgcgcaacgatttaaagctaccaatcgcttatcacactggcgcaggcggccatgattggctgtattggcagcgaatgctaccggaaatgttgacttggctattgaaggttaatctggcggatggtcagccgttggagagttaatgcgcaagaaagccgaagtaaccaatcacaatcagacttaaaataatgcggtaccagccaaagattttgaagttgttatgttgaatgtagttcagtaagaagcgaatggcgaagtaggccacaacgaacgaaaccagcatgccagtcaacaggacggctgtctgcataccggtaaaagcgccgccatggctgaaatatttgtagactttcagcagggatgcaccaaacatggttgggattgccaagaaaaacgagaactcggtggcaacatatcgcgaagtgccaattagaatgccgcccaagatggtggcacccgagcgagaggttccgggaaccagggaaagcagctggaacatcccgataataaaggcagttcgataggagagcgtattgagatcggaaaatagcggttgccggtttgcatttcggttttcgatgaggataaataataccccatatatgagaagcattgccgagacaacttgccaattcatcaagtgtgcgtccatccagtcgttgaataataacccgatgacaacagagggcagcactgccacaatgactttaaaccaaagtacccatgtctgatgttgttcgacgtgggttttctttggtgaaagggggttgagtttgtggaaatacaatacaacgactgccatgattgcccccagctgaataacgacgttgaacatgtcagtgaactgagtggtttgactcattttgataaattcgttgactaatattaaatgtcccgtggaactaattggcagaaattcggtgattccctcaacgattcctaaaataattgctttaatgatatctaacatcattccaacttccaatccctataaatttatgcattaagcatgacataaaatgtcctacaaaagtgggtatttacctattgtttacaatttttcgactcaatttttacattatggggtcgattcgacttacttgctcgaactcgtgattgcgcttacaattgcgctagttagacaaatgaggaggaagatattatgaaggcatatggatatgagaaacatggggatccagaagtttttcaagaatatgaagttccagagccaacgccggctgccaaccaagtgctcattcgaacaattgccgttggcttaaacaatcgtgagcgtgcagaacgtgccggcggctttggcagcatgccgtcaccgtatattcctggacgagatgtggttggcgaaatcgtgaaagtcggtaagcgggtttccgatctcagtgagggtgaactggtgatgacccacactgagcggggctacgctgagtttgtacttggtaatttagacgccacggttgtggttccagacgggattacgccgacacgggcagcaggtctgattacccctggtctgaccgcctataaagctgtgaaatattttgccaacgttcaacctgatcagacagtgatcgtcaaaggggcctctggtggtgtcggatcacttgccgttcagattgcgactgatattggcgctaatgtaattggcattgcctccagtcacaatcaagattatgttgaatcgattggggcaacgaagttcgttgcttatgatcagactgacccggccactgagctggcggatactggcgatgtcgttttgaataccgcaatgaatggtgccggaactgatgatgacgttacgatggtgaaaccaaacggcgtcattgccagtgttgcccataactcaccaatgacagataagccattgaaatttgcccacattcatccgactgatgcgatgagcgatcgcgaggctctgcaggcagtgatcgatttgatgcgtgaaggcaagctcgatattaatatcggctacaagctgccatttaatcgagatggatttgttaaaggccatcagttgcttgaggaaaagcatgatggacgcgtgattattgttaagtagacattttgagtcaaaaaaaccggacgccactttggtagggtccggttctttttgttgaggtgtgctgcacaagccagctttctccgctttatccaataataggcattgatgcaaagtgcgcatcaacacctattattacataaatgctcaaaagctaaccggcttgctccgcactgggattgaaatgtgctgcgagcaactgacactgcgatctaagccactttgattcaaatccaagcccaggatttcaatcaaagcgaccttagctctccgtgtcaaaacgttgctctccgcactctaatcaaagtgtctccactccctatccattaacgctcttgccacaaacaagcccattggcaggaagacgatgatcaaagcagccttggtcagccacaatgcgccgacactaatttggttgaggccgatgttatacacagcccgataaatgtacaatcccgggaccatgatgacaattgacggcaccgtcagtgaaattcttgggtatccgttataccggttaaccagtgaagcaatcagtcctgcaaccagggccgctatgaaagctgcggctgcaggtgggacgctcgtcagatcaaccatttccagtcttaaggtgttagccaccgcgccgattagtccggccgtcatggccattttctgagaactgttaaacataattgagaatccatagaccccacagaaactggctgggattcgcaataacatcaataccagtggtgatagtcccaatggtaagaagttttctggtcggaaatcaaataatagtgctaccagccagcccactaaggctgctacagcggtgatcatgatcgcgtaagccatccgttccagtccggatcgcatgtccagtttggaaatatccaggaaactggtaataaacggaaagccgggaatcacaaacagcatggcaccaatatagccagcctcatgttgagccagaatttggaaattggcttcaaagattttgaatgaaaacatgtaagtcaagcacgcaatggccacagcaatggaaatgctggcaattgtggtaatgtgttgtttacccattgacccccggaaatactgtccgacaccggcgccaatgaaagaacaaaccatttcagggatgccgccgcccagcaaaaaaataaaaccgctgcaggccaatgcggccgccaaaccagaaaccagcgggctgtactggacaggtcgttgttcgattttgctgatgttggcgtgaatttgtttgaccgtcgcattgccaaaatcccgttcaaaatggctgacaaagtgttccagtgagttgagcttatctgtgttcacaccagtattaggcagtgctagcacctgcgaataactgtggtcgttgataaaacaggtgaactgaagtgagctcaggccgatatccgccgaacaagtcagccccaacactctggccaccgtgttcattgcgtcacgaacccgccaggctccggttccacaggaaagcatgacaatcccaaccctaccaacgatagaagcccgttccctcaagccggcttctttggcggggacagattcgtccgtcgtgaatgatttccagggaatcgtcatatgatgattttgtgataaatggaattttttgggtgcgtttggttgctggctgtttgccatgatttcctccagaatactttttaaatcagtaaatgcatacaatattgtattatatgcggactgtgaaacaactttcaagctggtaagggcttacagtttgaaagtttctatcatgaatacataaaaaatccttgatagcagctatcaaggattaagaaacaatgatctgattgacatacgcagagttccgatacttactcgatcgaaactaactggacgttactggccccatccaccaagcggatttttcccaacaggttatcgatggttccggtaaaatgactcaggtccaatgagatgacgatactggcaatattgtggatggggatgttttggttaatcgtcaacacgctggcactggtttcagaaatggtcgtgaggactttggataagatccctcgcttgttttccagcatgagggagataacggcttttctgtccatcatgttttcttccggtaagaagaccaaatccttgtatttatagaaagttcctcgactaatgccgacaactttcacggcttcactgacctgcttgactttgccgctctccaatagttgacgagcttgaatcactttatcaaatgattccgggagaatcgagctatcaacgatgtaatacttttccacgttcacttacctcactcactacgccggttgaatcgactgccattttgcggacattccatcttgggaaggccgcttttgcgttggcagcgatttgatcggcatccttttcgtctgcggtgatggccatcatagttgaaccactgccgctaatgtacatcgtaccacccaattgttcggtgatgtttttggcctgactgtaatcggggattaattgagcccggtacggttcgtgcatccggtcatcgcaggcaacatggatcatatggctatcaccgatttccagtgctttagtcattgccgcacagtggctgacttgatgaatcacatctgcgtagctcattgatgtcggcagcacttttcgagcagcatgggtgctgacttcgtaatccggaatcatggccacaaagtgcagcttgtcactgacgtgatattggataacctgaggctgattttggtcatctaaaaaggagacgcacagtccacccagaatggccggggtgacgttatccggatggccttccatttcggtggccaagaccagcagttggtcgaccgaaattgcgtcatcgtaccagacgctggcggcttttaggccagccacaacacaaatcgatgaactaccaagtccacgggcaacggggacgttggtttcaatgtcgatttgaacatttggaacgggcttgtctaagaagctgcagcccttcacaaaggcttggtagaccaaattgtcttcattttgaaattctttcggggagccggtgatgaccaagtgctccgagctcttgtcaaaagtaatggttgaataataggacactgccaaacccaggcagtcaaaaccaaccccgacgttggcactagttgcgggcactttgatcttgatcataaaatacctcctcgactttttgtttgacgtaatcggtcatttgatctttttggatgacgctttcgtgacggacgggcagatcccagacttttctcaggttgtctggaattggtgcgttggttgcgtcatgtaagtcccgcatcacctgctggacgtccgctgaagtttctggaaggacggcattggcaaccgcattcacgaatttatagggactggcagtacttaacaggatcattggtgtttcggggtcgagcttttgataattgcgcatgactttgtagccggccgcggtatggggatccatcaagtagccgttttgttcgtagacttcggcgattgagcgttcaatatcttcatcggtactgtagccgcagtagaaatcctgctggatatttgccagaacttccttggaaacttcatacttgccgctgtcttccaagtcatccatcaattgtttaacgtattcggtgtcctgaccactcttatagtagaggagtcgttcaaagttgctggaaatttggatgtccatacttggagcaacggtctggaaaaatggccggttgcgatcgtagaccccgtgattaaagaagttggccaacacgttattttcattacatgcgacgacaaatttgttcacgggaaggcccagcattttggcgtagtagccggccaggacgtcaccaaagttaccggttggaacggtgaagttgaccttttggccgacttcaatcgagccatcgttgaccaactgtttataggaatcaaaataataaacgacttggggaatcagtcggccgatattgatcgagttggcacttgataagctgacatcgtcaccaagggattccttcagtgcctgatcattgaaaatccgtttaacgtttgtctgagcgtcatcaaaatttccttcaattgctgcgaccttggtgttgttcccaccggttgtgatcatctgcagcttttggatcttgctgacaccaccgtctggatagaagacaataatgcccatgttatccaagcccttaaagccttccaaggcggctttgccagtgtcgccactggtagccgtcaggatcattaccttattattgccgactaacacgtgcttcatcaattgaggcaatagctgcaagccaacatctttaaaggcactggttggtccatggaaaagttccaagatatggaaatcatcaacgggaataaccggggtaatcttttgggtgtcaaaacttgactgataagctgctcggacactttcgtcaatttcatcggcagaaaagtccggcaataaaatcgtcagcactgctctggcaatatcttgataatttaattttaacaatttttcgaagtttatttggagcttttccaagtcaggataaacgaagagacccttgtcatcagcgaagcccttcttgatggcctgcttggctgaaatttgaactgaaccgtttctggtactcgtataatatttattcatcaacttactccttgcatttctatgatttatatgataatctgttttcatgttaaatacaagtgtttattatttgtgaacacgaaaaaattggaggtttcagctgtgaatattgcgatattaggattcggaacagtcggttccggcgtttacaagattattaagaatgcgaagcgccaagcccaaaacctccatgtaaagcatattttgatcagaaagaataaaaaaccggatttaccggaaatgactgacagcattgatgaaattttgaacgatcaagatgtcgatgttgtggttgaagtcatcggtggcattgaaccggcgcatcaatacatagtcgatgccttgaagcaccataagcacgttattaccgctaataaagcagtgattgctcagtatatggatgaattcacgagagtggctgcccaaaacgacgcaaaattttattttgaatccagcgtcggtggtgggattccctggattcaaggcttggagcgggctttacgggtcgacgatgtgaataagatccaaggaatcttcaatggaacgagtaattttatcctcgaccagatgcaccgaaccggcaaaccattcaacgaagtgttgatggaggcccaacaattaggttacgccgaggccgatccaagtgccgatatcgacggcctcgatgtagccaacaaattatgtatcagcgtcgatattgcatacgacctatttatcaagccaaccgaggaattgccaatctttgggattcgtaacattaccgaagatgacatgactcactttgacaagttggggatgaccatcaaattgatgggtaagagtcaccagcggggccatgagtttgactacatggttgagccgaccttgtactacggcgacaccctcgaagcccacacccgtgacaactataatttgatttcattgattggcgagacgattgggactttgaagttcatgggtcagggagctggccaactgccaactgccaacgccgtgattcaagatatcttggatattttccaaggtaaggaacatttgaagcgggaatttaagagtacctttaagttccagccgaacctgacccggaataattacattgtccgatcagagattgattgctcacagctgtttggcgactatgccccggaacttcggggtgactatctggtcgttcatgacattccagtcggtgagatgcatcaaaagatgagacgagtgttacaacgcgatgaaaccgcgtttatggcaagtttaccaactaagaaaggaggagcagaaaaatgatagtagctaaatttggtggaagttcagttgcggatgccggccaatttaaaaaggtccgggcaatcgtagaagcaaatgcagatcgaaaagtaatcgtggtgagtgccgcaggtaagagtgatagtgaggcgattaaagtcaccgatttattaattgaagttgagaaacttcgagatgccggtgaagattacatgccagtgtataaccacatccaaagccgatttgtcggcattcgggatgcacttggtttgaaggtgggcattgaaaccgacttgcagaaaattgccaagcagattcctaactgcagtcatgattatttggtatcacgaggcgaatttttaactgccaaattaatggccgatttccttggctaccaattcattgacgctgcccgctttctggtatttgaccaaaacggcgtcaactatggggaatccattaaccgtctgcgcgactttttaagctacgatgaccacatcgtcgttcccggtttctatggggttgatgaagacggtttgactcacttgatgcctcgcggtggaagtgacatttccggtgcgctgttggccaactttgtggatgccgatctctatgagaactggactgacgtgtcaggcattaagatggctgatcctcggattatcaataactcccgcaagattaccgaactaacttatgaagaactccaagaactgtcctatatgggcatcagcgtctttcaggaagaggcgattcaacctgccaaagaaaagcagattccaattgccattttaaacactaatcatcctgaagaagatgggaccctggtagtcgattctgcgaacagtaacgctcaccagttggtaactggaattgccggtaagaaggattatgtggtgatttccatccaaaagtatcaattgaacaaacgccttgatgtgatggccaaagtcttctccgtgattcaaaagtttggcgtcaaatttgattacgtcccagccggatccgattcagttcaatttttggcgaagcggacggatgttgacggcaaattgatggcgattgtcaactcactgaagtcaacctgcgatttagacagtgtcaaattggagaaaaacatcgctatggttgcggcggtttcctcccaacttagtaaacgcccggcaatcgctggtaagattctcgaccttttggataacagtcagattaagattcatttggtggtccaggagggcagcgatattaaagtcgtctttggcgttgccaatagtgattacgaaaaaaccatcgaaaaaatctaccggagcgctgctgtaagtgcgaccaggcttaagatggtaatttaaagaaggtatctactcaaataagctgaactatagactctttgatcattggatctggtgagtttgtggttcagcttatttttgttcaattcgtttatgttaacgagtcatcaggggtgaaatttggtacaattaatttatcaactttacaatgtggaacgggtgagaggtaatctaatggttaagccaatgaatatcaaagcaatcaaagataaggataaacaacaggctaaggaaagattccacagaattttggaagaggcaaagaaaaagcaaacccaattaaaaaaggccaccacaaatcgtggtcagcaaacaaatcaagctccgcagcacaccgataacgatcgacagaagagcaggttaaaacgggagaataaaaagctccagaaaaaagttcgggctattcaaagtgagaagaatgcccaagagcaaataatgcaacggctcaaagcaaaaaactttgcattaaaccaagcaaatgatcaacttgagggcaaagtccataatgcccagattaaacttcaagaagccgaccaactaaaggcaactgactatcatacccaaatgcagttgaaacaaacgattgaccaacttaatcagcaaatccaattactcaacaggcgcaatcgaagtctgcgaaccggcatccgccattttattaaaagctcacagtaccagaaagctcagcaggttaaagcggataagcaatattacaaggaccaacttgaaaaaacaagggctcacttgaagagctcggaaaaacgaaataccaagtatcaagaacagctccatcaataccggcactatgaattgccgggcaaaggaaaactcgtccgacaagcaactacccaagagttaatcaacgaattatttgccagaattgacgaggaacgagtgggtgaattcttgtcgttactgccgctttttaacatgattgattattatttgaagacggggatgaccaacaccaagattcatctgcggcgatcagagttgctaaaagataaccaacagatgtatggctacgtccactttcaagacgaccaacctgagtttattgctttagatggatcggtgttcccgaatccggttgtgaagggaaataaatttgagctcaatcaaggtgatgtatatcgcgggaactataatttaaccaccgatcagtttgtgattaacaaacattacgctgcatcaacggaaaatcgcgatcgttccgctgaattacatcaagttaagaaaaaagccgccaaattatcggcaaaagggtttgttgagcggtttacaatcgattatcccgatgtgaaagatgttttgaccggtaagaatattgaagtggtttcatggttcaagcagattagctacaaacgggtatttgaaccatttggagttaatatcgatgttttggatcccaacgaacgtagtggcgattttatttatcgaagaattgaaaatactgatacggacctggcttttattttgctggagggatcccatcatgttaacagtcagatctataaggaccgaccggccgcaaatccggataaaattaaaatcctggaagatgctgcacccaaagaattactaaagatgacgtatgatcatttcaaatcattagcaactcggacgcgtactttggacgagaactaatcttgattgggggaagacattgctctgtggataatttgttgaatgtcattcaacgtgttgtcgtgactgctttcctctcggaccaacaaataaaaatcacgggaaaaatgttccccaagtgattcaatcggaacagcggtaggtagatccttgtcagacaacagggcttgaccgacaccttttgccaccattcgacgaatgaggccactattattcacatggatcagtttggcgggctggacatcggcttcacggaaatactgttcggtataatagccgattcccgatcctggttctcgagtgatccaattgccgttgtccacgccggctttgaccagctgatctttaccgattgaaattcgggagatgttctcggtaaccagtggcttttcgatgatcccgatatcaatcttgtaggtttctagctggtttaagacgccctcggagttggagacagtcacatcaaaatcgagggtaggatcggccgttaccagagcactggcaattttcgcaaacaagattcgcgaaacggtttgcgatatgccaaagatcactttttcatttcctttatcacctaagcgggtgatttgatcgttgacatcctgccagtttttaaggatcttgcctgctcgtttatataacaggttggcagcttcggtgggcacaatttcccggcggctttttcgttcaaacaattcggtgtgcagctgcaattccagttgtttaatctggttggacaccgttggttgcgtgataaagagctgttgggcagccaggaaaaactgcgggttttgtagacaaccatgaaggtttccaggaatttaaacatattggcactccttataaatttggtttataacaaatattaatactatcaattttatttattctaccataaatgatattattaagctcatctaagagaggagacgaccgtatgaagttatttttgaagaagttacctttaccaatttgtggattaattcttgggattgcctcgttaggaaacctgtttaaggcaattggcttaccagtgattggcaatgtctgggggattcttgccctggttctgattttactggtgatcgcaaagattggcgttcattttaaattaagtctgaacgacttgaacgacccgattattgcatccgttgccccaaccttcacgatgtctttgatgattatcagtacattcctgaaatcatgggggcttccagtattacccacagccgtttggacgttcgcagtgattttgcaatttgtcattatgggttattttatctaccgccatttgctacgtccgacagttgaactcgatcatgtttatccaagttggttcgtaacttttgtgggaatcggagtgattccggttaccgcaaataatttcattccggcacttgggacaccggtattgtggctgtctcttgggctctacgcaattctattgccaattgtctgcattcgcttgcttcgacgggagtttatgtttgaagcaaccttgccgctattgacgattatggctgctccggcatcattgtgcctgaccggttatctgtcgatgaataccaacccatcgtggggattcgccttagcaatggtgatcctggctcaagggttgtattggggaaccctgacgaagatctttaaatacgttcggttagccttttaccccagtttcggggcctttacattccccttggtgatttctgccactgcattgaatctgtttaataacagtttccacttgggaaacggtctcaactcaatcattggcacgatcgcaaacctggaaatcaccctggcaacctttatggtcgtctttgtggtgatcaagtatggccaattcctggtgaagcttgccacccaagcagttacggaaaacaaaatagctgcgtctgaaaatgaaaccaccgttaaataattgaatcgatacaaaaacggaaaccatgtttgcaattggtttccgcttttatttacatgttaaaagctttcgagtactgaaccattccatgaacaccatccaagccgccgtcaaccaatggcttagccatgaagacatcgtctggaaccggtgtgggagacttgataccataatcgctggccttctgataaccaaagcgaggatagtaatccggccagccggtcacaacggtgaattgatagccaaggttgattgcccgattatcgagttcgccataatcaaactgccaacaccggatttttgcgatccgggttcaacagccaaaggtgctaataccaaccctgtggatgctttggcaccatcgacaaccttgacttcactcagcaagccatagccaaccaagtgaatcccattttcggccacgacttccaatcgtttttggtaaatgggctctttccgaatcttatcaaccaattcggcttcattccgatagccattggcggtgttggcaaatgctgttcgaattaagttactgacgtttgaatagtcactttgacgaattgttctaatcatcagcatgcagcagccctccgtttcaacttatgtattaaaataatctcattttttgttatccgtatgagaaatgtatgttgctgcagcataacagacaatcaagataaccaatccaacactcaccaatggcacagcgacagttcgattacccatgattaagaaaatcacggcagcgatacacatcaccatcgaaattaacccggcaaaaccaattaatgcccgcattcaattcacctccaatcaatctaactgatacatcgagtataccgaaatcgaccaccaattacaaaagttctcaaaaatttttaagccgctcaaccccttgataaaatggcattttcatgagactgctctcataaaagtgtaaaaaagttgttgacagtttctccgttcatgagctatagttcatgcaacatctaaatacgactaattgatttggtccgatggattagatttacagccttaccaagagagtgcctggttggtgtgagggcattaagactatgaattgaaagatcgagcaaaataagttcacttttcgaggtggaatggtagcacccattaacgtgccggcgtatcggatttttcccgtacgcttcgaggagttgtttgtgaagacaactcaaattaaggtggtaccacgttgaacttaacgtcctttggttttgataaccaaggggcgtttttttagtcggatttgtttgtagtgagcggagtcaggcggttagaaaccggagcataagtctccttggacaagaattcctggttttggaatttttgggcaaggtgcttatgcgtaggtttctgcctgacgcagctgtcctaaataaaaaataaaaggagtggtcattatgaagtacggtattattggcgcaggagcaatgggagttaggtatggcgtaatgttacaagagaatgccggggtcgacgttgatttcatcgacacttgtgagccaaacgttgagaagatccgcgaacaaggcggtgtcactgtcgctcgtgaccacgaaaaccgacgcattgttccaatcaacatctactatccagaagaatataaaggtcacccggatgtttggattgttttcaagaagcagatgcagttagctgaagaattagagcgcgataataaggccggtatctttcatgatgatcaatatgtcttttctgcaatgaatggaatgggccactttgaaaagattgccaagtatttccctaaagataacattatctgtgggactgcgatgattgccactcgaatggatggcccagctgatattgatttcatgggggctgaaggtgacgaggtcatgcacatggctcgttacaacaacgaaaagccggacaccaagactcaagcgatcttcgacgacttcaccaatgccaaattaggaccggtcttcgccgacgaatggatgggcatgtgcatgtccaaagttgttttcaacgctgtgacgaacacattatgtacaatgtttgaaatgcaaatgggccagttcatcgagtatccgggtgttcgaaagatgtcgcagcaattattcgatgaagcctatgacgcttgtgagcgggccggaatttatcttatcgccactcgtcaggaacaggttgattcagtcattagtgtcagcaaggaatacaaatatcattatccatcaatgtatcaagatttctcaaagggccgaccaactgaagttgattacattaacggctacattgccaaaattggtcgtgaacacgactacgtttgccgaacccacgagtttgtggttcaagaagttcacatggcagaaatgatgcggaaataccacaaaccgcaaacgaacgtggcagatcaaaatgatgacacacaaaaggcaggtgttcgcgtatgagtttccgattttcagaacgagttcccaaaaacgatagcgatccggtcggcgatatattaaaagtcgccggcagcccagatgtgatttcctttgctggcgggttacccgcccctgaattatttcccattgaggccttaaagaaagtgaccaatgaggtgttcgatgagagtggtcgggaagcattacagtattcttctgctattggttatcctgccttacgtgagcaaattgcccaacgcatgaacaggcagggcatcaaagccactgcggataatataatgattacaaccggttcgcaacagtcgatcgacatcaccgctaaaatgtttgtcaatcctggtgatacagtgatcgtcgagaagccgacctacctttgtgccttagatgttttccgcagttatggtgcccatattgtcggtgtggaaatggatgaagacggcatgcggatggatcaactggaaaaggccgttgctgctaatcccaacaccaaatttatttacacgatcccgaatttccaaaatccaactggtcgaaccatgtcggctgaacgtcgtgaacaaatgattgagattgccaacaagtacgacatcatgatcatggaagatgatccttatggggccatccggtttgccggcgacgacattgaaccggtcaagttttatgataatgaagagcgggtaatttacttaagtaccttctcgaaaatcttagctcctggattaagattaggctggatcgtgatgaacaaagacttaatgcctaaatatagtgtgatgaaacaatccgcagatgttcattcggataatttaacccaacacattgttgctaaatttatggctgaatataacattgacgagcatgtcaataagattcgcaaagtttatcgcaaacgtgaaaatgtgatgatggcagccatcgagaagtatttcccagccggcgtcaactatagtcacccacaaggcggcctgttcatttgggtcgaagtgccgggagatgttgataccattaaattattcaacacctgcattaagcacaacgtcgcctttgtaccaggtgaaccattttatcctgacaaggtcactcctggaaccttcagattaaactattccaacatgtctgaagaacagattcaaaccgggattgagcgcttaggcagtgcgattaaagaaacaattgaccaaaatcaaaccactcgtgtggctcagcactaacttagaagcaattaaggaggttgataccagcatttggattaaataatccgaccaactcagagatttggatgacatagtgagaagtagaaatgcttccaggggaaacctgacacatagtatagaagaaatcgaaaataatgatgaaatgaaatggaagttcctgcaggcgtgcgggaacttttttgtacataagcttcatttaagctcgccacagtaaactatgtccatcaatcataaatgaacggaggaatgcatatggatattttgaaaatggatgcaaccgattactgggaagactttatgcgtcgcagccgcacccagaaaactaattttgaaacttggtcgtttaccaaccggcccaattcaactgatatgttggttgaaatggtagttcgtggacagaagaccgctgccagctcctggtttgatttttatgatgccgaccaggtggtgccaaaggtcggcgactatcggatgttactcaagcggaatggcgatccggcctgcattgttcagctaaaagttgtcgaggttgtcccattcaaatgggtatctcaagaacacgcctatttggaaggcgaagggaatcgttcgctgaaatattggcggcaactccacaaacagcttttccggaagcaagccaagattcgtggcaagtcgttttcactggaaagccccgttgtctgcgaagtatttgaggtcattgataccccacaaatttaattgttgatgctccccgataaatggtagtatattagttgcgagttaattcgactatacgactttttgagggggcaacaccgtggattccactgttaatgaacaaaatgagaacgcccaaaagcatccattcctggtgattaccgtcgtggcattcatgacctttatgggagtgctgactgaaacatcgatgaacgttaccttcccaactttgatggaccagttcaacatttccctgcccaccgttcaatgggtcaccacggggtatctgctgatggtggcgctattgacgattacctcagcctttttgaaacggcggttcaccaacaaacagctctttgtgtcagcagcactgctgttcattgccggggatgtgatgtgcggtttggcgccaaattattggacgctactggtggggcgcttggtccaggcgggatgtgttggcctgacgggaccactaatgaataacattattttagacgtcgttcccgcccacaaattgggaacctatatggggatggccaacttgatcgtcttggttgcaccagcgttggggccaatgttcggcggggcggtcgtgtcatttgccagctggcggatgattttttggatcaccgtgccgattaccctggttctgttgctgttggggatcttcattatcaagcagtatacgccgaccgaacactatgagtttgactggctgcggttcggtgtgctggcgttagcaatgattaccctgctcatgggctttaatattgtgggccagcgtgggtttttagttaaattcatctgctacatggtggtcagtgccgcttcattttgcttgttcggctggctgtcaaaatccagtcacaaagcattattcaaactgtccgtcttcaaacgaccggtatttctgtttagttttctaccctatgtttttctgcagtattcaaacatcggcctgaacttcatgctgccaagttatgtgcagattgtgaacagcgccagtgcctttatcgctgggctgattttgctgcccgggagtgtcctaaatggattggggcagccgatttatggatggatgttggaccgatttggcggcaaactacctctttatctggggaattcgctgtttctcgttccaattgtgattatgatggtaatgggtcaacaaatgtccgttttggtgattaccattctgtacacggtttacgcaacgggccgttcgatggcgtttggcaatagcatggcctatggcttgaaacatttgccaaaagatgaacagaaggatgccaatgccatatacggcaccggaaatatgttggcgggatcgcttggaacaacggtcattgcgactatgatgacctcggtacacatctacaccctgtcttatgtgcaaaacatcgtcgtcggcagccggttggcatttgggatgttggctttgcttgggctggttaactttttcctgtttaggaagttgtttaagagcggcaagtagggatgtaacaacctgtaatttttgatatccttaaatcatgaaactcaagactaaaaatctaataatcaccattgctttgcttatcttggccggcctcactgcatattttggtcactatcggtctgcaatgggaaacgtgatctctattcctgtcctagtaattcttgttacttggagagacaaaacataaatccgcgcaagtagttaccttacgtaaatctaaggtaacttttttattttgtcttgcgtcatatctgaatattcagtgacggtaattttgacaaagaaagcccaatgtctgataattatggctgagaaacagttgaacggatcaaactctgtcacagaataagatgtgataaaccaacaagttgaggggtcgaagatgaagaaagtattgatgttaataactttaagttttgcatttttgattggtggtgttggttcccaaacggttgatgccgtgaagcaaccacaatctgcctttaagaatatcaaatacattaatgacttcaattacaataagttcagcaatgtcgctgttcacgccaagaatattaagaagaatgcatacatttggaacgatacgcacactaagaagctttataatttgaagaattatccaacttacacttggtttaagacggcgacgggcagttacaaagggaacaataactggattcaagttaccaattattccactatgaattcaaaacggggatggatttggaagggctatttaaaagcgggatttaatccaacaggctatcaaattcttcagaagcggtatggccaacctcaatatgcaggaggccagtatcatgttgcaagcggacaaaagaacgtttacctttggaattggtcacacacaaaggtacgagcaaatctaaagcattatacgaatcaaacattttctcgaaggcattctattctagttagccataatggtaaccagcaatggtattattacacagatgtggataccaagaatggtacaatttccgggtacgtgaaggctagtcaaatggctaaagggcgttcaaaaaattatcatgggaatgtgattgtgtatccttctgaatttgataacacaagcgattacttaagctatattaaggataataatcaccaaaaattagttcgggctatcattaagttattccccaacacgcctgttgactatcagctttcatattatgcagtagtcaattatggtattatgcgtgacccagggtgggatggtgacgattttgatcctgatcctgtcaaaggatattccgacattgtttccttcaagccggttattaactacttaatgagtcatcggaatgaatctaatgctcaaaaactggctggtgtcaaaaagttgcttgctaaagccgggtatacacaggaaaaacgtgatgagttgtccggatatcgactgggaatttatatgcttaataatgtaaaagactccgcatcaactaaaagtacttccagaattaattggtatggcttgattattggaaaaccaaacgaatagcgagcaatgcgcatccataatagtgattaaatatatccaagtaaatatttcgctatgtttacacgaatgaataagaccagttccttacacctacagtggtagatgtagaaactggtctttatatttgtggagctgatgacttgacgattatctcgctctgacatttcctaatgtctgctcagtattctactccggaacatattccaaaatgtctcctggctggcagtccaaaactttacaaattcttgccagagtctcaaagcgaatccccttggctttccccgttttaagaatcgataggttggctggggtaatattaatttctgctgccaacatctttgaagtgatttgtttatccaacaacactctgtctagatttactttgatcaaagacaccaccgcctaaacaattttgtccgagtcttcttgaagatcgataccatatttgaacattacatagatcacgtagagggcaaaccaaatgagtagcgaggtaccgtcgcctccttggtcggatgaaatcgacgatgagttaatattataggtgtcggctaagactccgctacagtagttggttaaaatgatacccccatacccccaaagaataccttggatgtattttaaattaattggcttgaaatagatgtttcgacggacatttgcaatcagcttgaagactgaaaatgagacaagggtaattaatcccaatataatgagcaataatgcaaatgataagcagatcacccaaatgttcgtcgatccgccaattccactaatgatatcgtgaaaaatcccggtacgagcagatggaattagtagataaacgattccagcaatcacaaagacaagtgccaaagttcccattgcaattaataatgaagccacacttagcagactgatgacgtataaaaagttgatgaacgtatttggttgtttcttaatcatggtaaccactcccttttgatattattgtaacgcggaaattaattattgcaagacaataattaattatcgttttgtataaaaattctggtatttctgatgtaagtggttgggaaaaattctgtgaacaatacctcgtttggggaaagggatgctttcttgacccagaatatctttttagtataacctaaagatgtgactttaaattatctcaacatgggagtattcttatgaacttttcgattgttgccggagtaatcagtcttgcgatcacggctggtatcctttggatcatttacaaaataatcagggcaatctttaaccacagaatttaattgccaatgaacaaaaacgcttcaagagaactaaaattctcctgaagcgtttttgttcattggcacgttgcttcttaaatcttcaaaaagtctggatctttatatgctggatttggatagtggtagaagccttcgccggattccattcccagcttgccggcatccagtaattccttgagtttgtcagcgagaacttgagcatttggatcttcgccactcttggcttgggtcgcagtgatgttgtaagcggtccggatgccaacgacatccagaatggcaaatggacccattggtgcaccggtggctgccatccaggtcttatcaatcatttctggatcggcaaccccctttacccaaagttcttcaccagcgctcaacagtggaattaacagtgagttcagaatatagccgggttgttctttctttaactcgattggaatcatgccaatgtttcgagcaaattcgacaatttcatcgtagatttttggatctgtttttggcgatcccattatttcagcggtgttgttcagccaaacttggttggcaaagtgcatgtttaagaactggctcggccggccggtatcttccatcagtgcacttggaaccaacgttgatgaattactggtaaagatggcctctttgggtgccatctcaccaatcttgttgtagaacggtttcttgatgtctagtcgctctggaatggcttcgatgaccaggtcagcatttttaactgcgtctgccaaatcccaagtatagctgattcgtgataaaccagcttcgaaatcggcatcggtggccgcaatgtcatgccgataactgtgtcgcaaccccttgattcgctccttggcggcattaatggcatcctcgttaatatcataaactgtgacgttgaatcctttaaaagctgtttggaaagcaatttggcttcctaaaaccccactacctgcaaccgttacgtttttgattgtcatgataaaatcccccttaataaatgaaagcggttacgtgattcaccttaattataagtggtcggctatggaaagcaatcaaaagcattgttaaaaattattatcgtccgcaacgactggttgcacgccatcgcccttaagatgagcgtgcatcacccgactaataatggcataataataacaatcaaatttgtgaagagaagtggttaacatggtgttgggacaacgcattaaagaagaacgtgaaaagttgggctggacccaggatcgattggccgaagagctgcatgtcagccgccaagcgatttctaaatgggaagttggttcagcgtatccggatattgaacggttgattcagttaagtgatttatttggggttagtttggacagcttgattaagggcgacgagcggctgcagaaaaagattgtcatcggaagtaatcatgatcaaatgaacttttggggatttatgaattataatagttcagtcatcctccccgtcgccgtcctgatcttcgttgcggtaattgtcatttttggataatcgttacagtccgaataagagccctttgcttgctttccccgccgatttagcttatattgaccgcgaaatcaaagggggaattcatatgtttaattgggagacattcgaaccagatgagtacagtcgagataaagaaccgagctttgttgatctaaccacacgaagttatgtaactgccgaagggcatgcgacccagcacacggacgaccctgacttcatacggctggccaatgcggctgcagaagttgccaagacaatcagcggtggccctgagaaggggattccggtcgagggcttcaaagaataccgcccatacccggttcaagcggtttggactgataccggagacggtgaagactttaagatttggattaagcagccgttattcattaacgaaaaggatttcgacgctgccttaactcagattgatttctcagattttgatttgggagaaatcaagtttgagcatttggctgaaggcattgaaattcagaccattaataccggtgctgtaacctcggatagtgaagcactgaagaccttggacaatacgatccaaaagcagggcttcactcgtctgcacggaaatgagcatcgggaaatctacattgacggcctgccggtggattccagcaagcttgttttggttcgcttggcaatcgatgccaatggcaaagagttgccggggttggtccataattaacaatgccgtaaacaggttactctactcatagcgaatcatcaattgacgacttgttcactgacacctatacggcgaactttgtaataattgtttatgtactggtcagaaaaatcaattagaaaagaggctccacacctgacatatctaatgtgtggaacctctttagtgaaatttgagagctttatttaaatgattggctgcatttttcctttttagaatagcaattcgttaatatcgcaatcaaaaatttgtgttaatcttaccaaattttcgatgtcagggtatgtgaggttgtgttcccattgggagattgcttgacgactaacccctaatctgcatgcaataatttcttgtgaaagctcattgtattggcgaaactcttttaaattatttccaagatttatcattttacctccatttgtcaaatagtatcataaatacattcgacagtatacgtgtgaataatgtgtgaatgtcgtttaaaagctttgtgaatattatcaaaagtattggatgaactttttgtaagctcagttaatatcaagcaatacttgcgcaagcaatcctttcttgcgatgtgtgtacttttccgaaataatgggttttgaaatataaataaatctactcatattttggaggtttttagtattaaacaagaaagaaaagtattcgtataggtgtaaccatgatgtcagcggtgttgttatcttccatggcggttcaagacatatcaaccgtcaatgcagatagttctgcccgatccttggtggctagtgacagcaccacaaaattttcggatacagatcaggcttcggatcaaaatgttacggtagccaattctaatgagcagtggaaagaattttctaaggaatgtaagttattatctcagtaaaacttgcccgaggatcaattgagcgcaaaaatgcaagatttattaaataaatatgatggtgctgaagcagatattcagttcaacgatgcaggggctactaatgaagtagggctgcgttcgattacaaagcctgcgagtgttcatgaaaagatagtcaagggtggagtcaatgattttgcaggatcaaccagtgcattagcaaaattacgtacgtattatggtttaattcaagatgagttggtgaccggaggagccgtcgtgggcgtaatttcggcgggattatttggcgcaatctttggtgcaggggcaggaggtattctgtcagtaagatcaggatcagcacaatcggatgtgaaaacaatgattaataatggaaaatcaaaaggtgggtgtcggatcacacttacggatgaatttccaattgcttctctgacttcaaccagtcaaagtaaactgtaatttactcaaaagcagcctgagcagaaggataaaatccttttactcaggctgctttttaatttagtgggttgtcgccaattgttcaagtagacaatgtgaatcggatatcttttgcctttggtgaattatgttactcattatcttcgagcttcaaactgaccgtttcccaactggactctgtttctgtgatttgggcagtcacctgatcgagctgctgttgaagatcttgcaactttcccaggtcgttaaagacgtccggcttcgtcatttctgcttcaatttgatcctttgattgtgtcaattcatcaagtttggtttccagagccttgacttctctttcaagtttgcgatgttctttttgggtttgcttattaatctcgtagttctttttatcggtggtcggcacagcaactggagtcggttggcccgctgccttcttttcagcctcatgagccttgatggcttcttgctcatcttttttgtcgacataataatcataattcccaaggtaaagggtggtgccatgtcgggacaattcaacgaccgccgtggcaattttgttgataaaataacggtcatgggaaacaaagagaattgtgccgtcgaattgattgagggctttttccaacacttctcggctgtcgatatccaagtgattggtgggctcatccaacattaaaaagttgttgtgctgcatcgccaacttggttaggagcaaccgggccttttcaccgccggacagatcatggaccatcttgctcacgtcgtcaccggagaaaaggaagctccctagaatgcttctaatatcgccttccggggtcgttgggtgatcatcccatagttcctcaagaacggttttagaggcatgtagtgaggcttgttcctggtcgtagtaaccggtaccgacgccagtaccaaactgcgccttgccctttaaaaatggaatgatgcccaagatgctttttaagagcgtcgatttgccgacaccgtttggaccaacaattgcgatcgcttggtgacgtttaacgtccagattaaccggctcacaaagaaccgtgctgtagccaaccgctgcgttggtaacattcaggacgttattgccgcttttggattttggtgaaaatgagaagcgggcagtttttgaatcagccgtcggtttttgcagcttatccattttttcgagttgttttcggcgggcctgcgcctgtttggtggtcgatgctcgaacgatatttttgtcaacgaaggtctgcagtttttgaatcttagcctgctgcttgtcatattctttccattcttgttcaatcaactggtcttttttcttggtgtagtccgtgtaattaccagtgaagtggtggagggtaccttgtgacatctcgtaaacctcagtgacaattctgtctaggaagtaacggtcatgtgaaatgatcagaagggcaccactatagttttgaatataaccttccagccaagtgatcgtttccacatccaaatggttggttggttcatctaatattaataattcgggcttttccagtaacaatttggccaaggcaagttgagtcttctggccgcctgacaattcattaattggccgatcgtagtcagcttccccgaatccaaatccgtggagaacaccacgaatttcagcgtcgtacccataaccattgtgctgttcaaagtcggcacggatattgtcatattgtgaggaaatcgtttcatattcttcggtgttggcgtcaacgcccaaagaacccatttgtttttccagagcgtgaagctttgcttcctgctcttttagactggcaaagaccgatgccatttcagcataaatgcttttgtctgaattgagtccggtatcctgggccaaatagccaatcgacagattctttttagtgctgatttggccgccgtcgacagattgttcgccgatgatcattttaaccagtgtcgacttgccggcaccgttacggccaaccagtgcgacacggcttttttcttgaatggccaaattaacttttgagaaaatagtttcgccattgaatcgtttggttagatcttgtgcttgtaagattatcaagtgtttggccacctttcattttgtaactaccaacaatcaattttatcataatttacacgatttcaggaattatttgtaagtaatatttgaaatatatttcacaagatgtcatcttatggtagaatgagatgtaaataggaattcacaaagttcttttaactaaaatgacaaataggaggaaattttcttgacagctgaaaatattccacgcgcaaccgctaaacgattgccgatatattaccgatacttaaatattttacacgatacaggaaagcaacgaatttcatcaacggaattggccgaggcggtgcaggtggattcagcaaccattcgtcgtgacttttcctattttggtgctttgggcaagcggggttatggatacgatgttgataacctgctttcgtttttcaaaacgatcttgaatcaagagcatctgaccaacgtggctttgatcggagtcggcaatttgggccatgcgctcttgaactttaattttcacaaagacggcaacgttcgaatctctgctgcttttgataccgacgacaagattgtgaacacaattgaagacggtgttcctgtctacccgattgaggaactttcacatcaactgcatgatcaacagatcaaagtcatcattttgaccgtgccctcaaaagtcgctcagtccatcgcggacgatgctgtcgccggcggggtaaagggtgtcttgaactttacgccaattcggcttcaggttcctgaagatgtcctggttcaaaatgttgacttaactaatgaattgcaaactttgatttatttcatcgaaaactttggcaagtaaaatatcgaacaaattaatgaagaaaagaccggtgatcctgaaaacgccggtcttttcttatgcgctcatttaccgtcggcaaggcaatctgcagataaattcaccaagaaatgcgcagaaatccttgcaattggtctgaaaaaataatatattatacacagtgattagcacttttatcatgtgagtgctaatgttgctaaaaattgttgcaaacggagggactaacgtgttaaaaccattaggagatcgcgtaattatcgaaactgaaaaagaagaagaaaagtcggttggcggtatcgttcttgctgacaatgcaaaaaagaagccgcaagccggtacagttgttgccgtgggtgatggccgtgtacttgataatggtaccaaggttgcacctgttgtaaaaaagggcgacaaggttatgtttgataagtacgccggaaccgagattgaggataacgatcaaacttatctcgttcttcatgaaaaagacatcgtcgcaattgtcgaataattatattttaacaagataattgctaataagtgaatcatttgaatcattcaatgaatcaataatcaaaaatatttttttgaggtgaaatttgaaatggctaaacaagtaaagttttctgaagatgcccgtagcgcaatgctcaagggtgttgataaattagcagatacggttaaggcaacgattggacctaaaggccgcaacgttgttttggaacaaagtgccggtacaccgacaattaccaatgatggtgttaccatcgccaaatcaattgaattaccggatcattttgaaaacatgggtgccaaattggtttctgaagttgcttcaaagaccaatgacgttgctggtgacggaacaaccactgccacagttttaactcaagcaattgtcaatgaaggtatgaagaacgtcactgccggtgccaacccagttggaattcgtcgtggtattgaaaaggctactaaagccgctgttgatgcccttcacaaaatgtcgcatgatgttaagaccaaagatgatattgctcaaattgcttcaatttcatctgccaacaccgaagttggtaaattgattgccgatgcaatggaaaaagttggtcatgatggtgttattaccattgaagagtcacgtggtgttgataccagcttggacgtcgttgaaggaatgcaatttgatcgcggctacatgtcacaatacatggttaccgacaatgacaagatggaagccaacttggacaatccttacattttggtaactgataagaagatcaccaacattcaagacattttgccattactgcaaaagattgttgaacaaggtcgttcactcttgatcattgctgatgacattggcggtgaagctctgccaactcttgtattgaacaagatgagaggaacattcaacgtcgttgctgttaaggcacctggatttggtgaccgtcgtaaggatcaactccaagatatcgccattttgaccggtgcaaccttgattaccgatgaccttggtttgaacttgaaggatgcaacccttgaacaacttggtcaagctaacaaagttaacgttaccaaggattcaaccacgattgtcgacggttccggttcaaacgatgaaattgccaaccgagttgctgaaattaagacccaaatcgaaaagacgacttcagactttgaccgtgacaagttaaaggaacgtcttgccaagttatcaggtggagttgccgtggttcgtgtcggtgccgctaccgaaactgaattgaaagaaaagaagtatcgcattgaagatgccttgaatgcgacccgtgctgccgttgaagaaggattcgttcctggtggtggaactgccttgattaacgtcatcccagaaattgccaagttggatgccgaagctggcggtgatgaagagactggtattcgcattgttcttcgtgcccttgaagaacctgttcgtcaaatcgctgaaaatgccggtgttgaaggctcagtgattgttgaaaagctcaaggacgaaaagcctggaattggctacaatgctgccaatggtaaatttgaagatatgatcagtgacggaatcgttgatcctaccaaagttacccgttcagcacttcaaaatgctgcttctgtttcagccttgttgttgaccaccgaagctgttgttgctgatgagcctaagaaagacgcaccagctgctccaatgccacaacctggtatgggtatgtaatgaagcgttaaatcgttgatttgaatgaaagtattgtacaataagcatcgattccaaatcgggattggtgcttattttgtgcttgcgaattaatcaattcaatattaaagtagttagcatgtggcttagatcatattttgactctgagtgcacagctgacggatattttagcttgtctggatggtgatttgctgtgagcccattcagacatacatatcaagacttgtttttagttgtcagaaggactatcattttatggttcacaagaatggtagattattaaataaaggagtaactatttatgtggcgctatctcaaacggctccttattggaaagccattaaagaccactgatgagggtggtcaatctttaaccaaatttaaagcactggctttactatcatccgatgcgctctcgtcagttgcatatggtactgagcagattacgaccattttaattacgctgtctgcagctgcattgatgtatcaaatttgggttgcagccctcgttttggttctgttggctgccattaccttgtcgtaccagcaaattatccatgcttatccctctgggggcggggcttacgtggttgccagcaccaactggggtgagcaggccggcctgattgccggcggctctttgctggtcgattatatgctgaccgtggccgtatcaacaacttcagcgactgaagccattacatcagctattccgtcattatattcacatggggtgttgatttcctgtttgatcgttgtgggcattatgctcctcaaccttcgaggaatccgcgaatctgcttcgtttttgacgttgccagtgtatttgttcatcatcatgattatcgcgatgatcatttatggcggttataacattgtaaccggcaacatcgaatatcatgcggctgctcatattggggcacctgttgaaggcatgactttggtcctgttcttccgggccttctcatctggatcatcttcattgaccggtgttgaagcgatcagtaatgccgtccctaattttaacaaacccaagagtaaaaatgctgcggcgaccttagccatcatggcgaccatcttggcctgcttctttggcgggattaccttcctgagttactacatgggcattatgccaaacagccacgaaacagtcctttcacaaattggtgaaactgttttcggccatggcattgtctactatatcctccaattatcaactgccatgattttggcggttgctgccaacactggattctcagcatttccaattttggcttataacttggctaaagacaagttcttacctcatgcctatctcgacaaaggggatcggttggggtactctaacggcattatttccttagccgttggtgcgattgtcttaattcaaatctttggtggccggaccaattcactgattccattgtatgccgtaggtgtgttcattccatttacgttgtcacagtccggaatgattatccattggcggagaaatcggggcaagaattggcagctgaagtcggttatcaacttcgttggcgcctttatttcactgacgttggttacctgcctgtttttactaagatttccaaatgtttggccttatttgattgttatgccgattcttttgaggattttctacaagatcaatcatcattacaagcgggttgccgaacagctgcgggtggttgaagagaatactgaaattgcgacaactcaccattttgacggttcgactgtcattgtcctggtaagcggggtcactcgggtgactgccaatgctatcagttatgcccaatcgattggtgattatgtcatcgcaatgcacgtttcttttgactccaaccctgagaaggaacacaagacgtctgagcagttcaagaaagatttcccggatgtccgattcgttgatattcattcatcctatcggtccattgctcaaccaaccttacgtttctgtgatgtcattgccaagcgggcagctgatcgaaactattcgaccactgtcctggtaccacaatttgtgccaagacatcgttgggaaaatgtcctgcataaccagactagtttgagattaagagcaattttaaattcacgacaaaatattattatttccacttataactaccatctgcgtgagtagttaaatgaaacgatacaggccatccattagacaataacggatggcctgttttagtgtgtttttaaccgcctcgttccggtttcaccaggattgtgggcaattatcttgaaagacacgaaacgtgcttaggggagggataattgggtttgagtagtcgcctaacttcgagaaaaatatgtaaataaaaagatcgcccaaatggacgatcttttgatctcgcaaggaattagtgagcgattcccatgaagttggcaaatgttggaacaacgatgtcaacaacgattgaaatgataacaaccgcgatggcagccatcgcaccagatacagaacttaactgaatggcctttgctgaaccaacagtgtgtccggcagtacctaatccaagaccttgaccaattggttcagtcaagtggaatatcttgatgagccatgttgccaaagcgtaaatcaagacggcgttcaagatacatgccatagcagtaacggcaggagtacctccgatagcaccagagataggcattgcaatagcggtagtagcagcttgtggaagcattgaagcgattccgttgttgttcaagccgatgagctttgatacatagtagatgatgaacagtgagatgaacaaaccaataattaatgatagcagaatctctaaccagaatcgtttaacaatatcgttacgtttgtacagaggaacggcaaacgcaatggttgctgggttcaagaaccagaaaatgatatctccacctggtttgtaagcgttggtgtagaaccaagtaacgtcaacaccgaacatcttagccatcaaccagaggatgaagattccaagtaccattccaacaaacagaggttggaataagaagaatcctttaccaatcttgaatagccattgaccaaacaagaaaaccaacagtgacaagcagataccaaaaattggtgtccctaaatacgcaataatagttgtttgtgtagcagacatttatattcacccctttaattactttttctcgacgtcttcactaactgtaatatcgccatggaaaacggtctttctgatccagataaagaatgatgtggtgtaagcaacaacaacaagtaagacaaccgttgaaataataatagcaacaataagttgtacaccttgagccttcatgatatcaagagatgcggtcaattgaattcctgaaggtacaaatagaaatgcgatcattccgatcataaatgtagcaaatttatcaacccattcaactttgacgatgtggaaagttaataggagataaagaataattaaaccaagaactggggttggaacagggaactttggtgcgactgctaccaaccatgctgaaattaaactggaaacaaacaataccgcggcgaagatacccatttgaataagaatgggcgcatctttcgtctcggcttgtgtagtatttgttttgtcagccatgataaaaactccttccgtttgtgaaatataaaataattgaacctgttgtcttacaatctctagtataaatgtttttgtgaaatatgacaattgaaaacgttggcaaaatttaaaaatgtgaaaattcacacaattggtccgtattaattatttgagtaagctcctttactttgtgagtcagacataccttgtttttatgaattgtcatttgtataattgaattaatattgatttggaaggaaataagtgaggttacaattttgaaattcgagatcattgtgtctttatttgctaccatgattatttctgcagtcttaaccccatttattcggaaacttgcttttgctgttggggcagaggaccggccaaacaaacggcgggttaataaaattccaatgccaacgattggtgggttggcaatttttattgcctacacctttacgaccatgattttattgcgggatcagttcccaaccaaaattttgtggggggtgtatggcggggaagtcatcattattctcactgggataatagatgatattttcgtcttaaagccccggcaaaaagttttggggatttcaattgccgcgctgtgggtttactttacagccggcgttaaaatgaccaccattaccttaccgtttatcacaatccaccttggttggctgagtttgccggtaacttggatttggattttggcaatcactaacgcggttaacttgattgatggattggacggcttggccactggggttgcaattattgccctaaccaccatgggaattaccgccatgttcttcttgaacgtcggtaatattttcgttgccatcatgatttttaccctggtcgccgcttgcattggctttttgccttataactttttcccggcaagaatttatttgggcgacaccggtgcgttgtttattggatttatgatgtcggtcttttcgctgtttggcttaaagaacgccaccttcatcacgctgctaatcccagtgatgatcttgggtgtgccgattactgataccgtatttgccatttttcgccggttgttaaataaggaaccgattacgcatgccgataagcgacatttacatcaccgtttgatgcaaattggtttgacccatcggcaaacggtgttggtgatctatggaattgccctgattttttcgtttatctcactgctttatccgatttcaaccttgtggggctcgattctgctgacaattgccgtgttaatcggccttgaattgtttgtggaaacgattggcctggttggagaagatcgacagccgctgttgaatggcattaagaaattggttaaagatacgaccagtaaaaataatcattagtatcataaaaagtctgccaaatctttggcagacttttttatatcgatcactggaaagtttgaggcagctgcatctgttgcacgatttgataactcagtcagaatgatcctccttggtttcgtcatgttgtcttttttcacgagaataggggacctcaaagatttgatgtccgcctttttgatatgcaaattgatcacttaacaaattggtaatctgagtgatcaaggaatcaaaatcctcgtcactgactgccacgaccacttggactttggcggtataggctgtctcttcgattggaatcgattggctttccaagaaatactttagtttatcgaattgattgtaatcaattgtcagcgttattttctgtttatttaccagtttgacgatccctaatttatcaatcgttgtcgatgtcgcgttgctataagcccgaatcaaaccgccggcgccaagcttaatgccgccgaaatatcgggtcaccactgctaaaacattatgtaactcgttcattttgagaacttccaagatggggaccccggcggttccggatggctcgccattgtcgctttcgcgttgaatgtggtcatcgtcacccaacatgtaggcgtagcaattgtggttggctttggtattgtctttactcacctgatcaatgattttttttgcctggtcctcgttatcaattcgtgccatcgtgcagagaaagcgggattttttaatttcgatttcatgggtaccgtttgatttaattgtcagtgattcatttttcaaaaaggattcctccagtatttacgtaattagtgattgaggtgatgatctatgattaatgatctatcagagttgtatggccgccaaatgccacagcgtgatctggccgcgacactgcaaaattcaccggacattcgcttacgtccggccatcagtgatgaccatggattgaaatgtggtcgctgcgggtcaaaattgcgccattcacttgccagtttacccaatcaccacttttattgctacatttgtattcaaatgggtcgggtggataccttgtcgccactggcttatttggaagagccaaatcattttactgagaatccggatccattatcctggtccgggcagctgacccaattacaaaatgagtgtgccgacaaagtgattgaagtgtttcaacaacgccaacgtcacttgttatgggcagtgacgggagccggcaagacggaaatgctgtttaaagggattagctgggcagtttcaaatggtttgcgagtcgggattgcttcgccgcgggtggacgtatgcatcgaactgttcccacgaattcaagccgcgttcaatcaagtttcaatcgtgttactgcatggcaagagtgagcagcggtaccaatacagtcagattaccatttgtacgacccaccaactgttacgattttaccatgcctttgacgtcctgattgtcgacgaggtggatgtcttcccatattctggtaacccaatgcttcattttggtgttcaaaatgcgattaaacccgctggggcaacgctgtatttaacggcgacccccgatcaggcactgtttaaagcaatttctagaaaacagttgtcggtcagttatttaccaatcaggtatcatggacactatttaccggaaatctcggtaattcgggtcaaaaatcttaacgagcagcttcaatctggcaaactgcctcaaaaaatcttgcggatggtggctgacttggtagcagaaaagcagcggttcttactgttcgttccccacattaaagacttgggtcaagcggcagctgccatcaaggctgccgggatagcagcgaaattcaaaacggtgtattctgctgatcccgagcgaattgagaaagtggccttaatgcgcagtcaacaactggattttttgatcacaacgacgattttagaacggggcgtgaccttcccaggcattgacgtcttggtattaaaggcagacagtgaaattttttcggcggctgcactcgtccaaatcgctggtcgggtgggtcgaaatagtgatcggccgacgggacaggtcctcttttattgtgaatctaaaacggccaacatcaaatcctgtgaccgccagattaagctgatgaatcgaaaggcggctcaattatgaaagcctgtttattgtgtggctccagactgagacaggaaatcccacttgcagacttgattcggttaaccccactgcagaaacgggcgatctgtgaggcgtgttccgccactttttccgcgcttaatctgctaccaacttgttccagttgcggtcgacggcgaacaaatgatatgagcgatccctgctatgattgtctgcgctgggagaaggacggccaattcaaatttatcaactcggcgatgtacgaatataatccggcaatgaaagattacatgaaacgatacaagtttgccggtgattaccgattacggaaagttttttccgatcaaattcatgagcagttgaagaagcaatctgcgatcattgtgccaatcccggtggggaaggacaccgtggccactcggggctttaatcaggtgaccgggctgctggaaaatgaccgctatttaaacctcttaagcgtcagattcgacaagaaagccatccgccagtcggcgaaaaaccgtcagagtcggttattgcttgatcaaccgtttgaaatgattgaatcacaaaaaaatcaggttaaaaatcgggccgttttattggttgacgatgtgtatacaaccgggacaaccattaggcatgcggccgctttgatccaacaagccggggcagcttccgtgaaaggatttacccttgctcgataaagaaatccagacccaatgattgttaaaattcgaactttcaattatactaaagttgtagccagtaatgaaagtgatttcattagtggaccattaagcctttaatggtgaagggagagaacgctatgctaatttttaacattcgtggtgaaaacattgaggtaacccaggcgatccgggattatgttgaaaaacggatcagtaaactggagaaatactttgaaaaggacatgaaaaatactgctcatgtcaatttaaaggtttatccagataagcaagcaaaagttgaggtaaccattcctttgccatacttaactttgagagccgaagaaatgtccaacgatttgtacgcaagtgttgatctggtgacagacaaactcgaacgtcaaattcgtaagtacaagaccaaggttaaccgcaagtctcgtgaaaaaggatttaagaatcttgaatttgcacctgctgcagatacttctgccagcgagtcagattctgatgacgaatccaaattccaggttgttcgtaccaagcaactggctttaaagccgatggataacgaggaagccattcttcaaatggacatgctggggcatgatttcttcatctatgaagatgcagaaacttcaggcatcaacatcgtctaccgtcgtaatgatggccgttatggcttgattgagaccggcgaagaataattaagttaatcaattaacgggcatgcgtattatgcaccgtcaaaagaatggggataaattgcagcttaatttatccccattctttttcgtttccggaaacatttgtgaaccaatctgatcgtttaacctttcatatctattcaaaatgtattatcatggttaaatgccgctgatgcattgttttttgtgttttcatgggcggcctaaaatgttacactaaataagtatgtagtccacaaatactaagaacaatttgatcagtattttattttagaagggaatttactaatggctaatattttaagaacatgggttgaaagtgatacacgcgaacaaaagcggctcagtaaaattgccgataaagttggttcgtatgctgaagagtatcgtcaactcagtgatgaagaattacaagccaagacaccggcatttaagaaacgctatcaaaatggcgaaacactcgatgatttgcttccggaagcatttgccgttgcccgtgaaggcgcaaagcgtgtcttaggcttgtacccattccatgtccaaattatgggtggaattgttcttcatgaaggaaatattgcagaaatgaaaactggtgaaggtaagactttaactgccaccatgccggtttatttaaatgcacttgcaggcgaaggggttcacgtggttactgttaacgaatacctttcccaacgtgatgccactgaaatgggcgagttatataattggctcggcctgacagttggcgttaataccactgaaaaggatgccgatgagaagcgggaagcctacgctgccgacatcacctactcaaccaacggagaaatcggtttcgattatctgcgtgacaacatggttgcttataaggaacaaatggttcaacgtcctttgaacttcgcgattgtcgatgaggttgattcaattttaattgatgaagcccgaacaccattgattatttctggtcaatcaagcggcacttccgacctttaccaacggactgacagatttgccaagacgttgcacgaaggcgatgatttcaagcttgatctggaaaccaagactgtttcattgaccgatcagggaatcgaaaaggctgagaagtacttcaacttaaagaatctttatgacaccgacaatactgccttgacccaccatttggaccaggctttacgggccaactttatcatgcttcgtgataaggattacgtggttcaagatgatgaggtcaagattgttgattcctttaccggacggatcatggaaggccgtcgattctcagatggtcttcaccaagcccttgaagcaaaagaaggcgtcacgatcaacgaggaaagtaagacaatggctaccattacttaccaaaacctcttccggatgtataagaagctcgccggaatgactggtactgccaagactgaagctgaagaattccgtgagatctataacatggaagttatttcggttccaaccaacaaaccggttgtccgggttgatcatccagatgttttgtatccaactttggaagccaaatttgaggccgttgtcaacaagatcaaggagcttcacaaaaagggtcagccaatgttggttggtactgttgctgttgaaacttctgaatacttatcacaacgacttgatgaagaaaagattccccacgtggtattgaatgccaaaaaccacgccaaggaagctgaaattgttgccaatgccggccaacgtggtgccgttacaattgccaccaacatggctggtcgtggaaccgatatcaaattaggacccggagttgttgaacttggcggcttagctgttatcgggaccgaacgacatgagtcacgacggattgataaccagctgcgtggccgttcaggacgtcagggtgatcctggtttgtcacagttctatttgtcacttgaagatgacttgatgcgtcgttttggttctgaaaagatcaaaaacttcctggagcatttaaatgttgaaggtgaagacgcggttattcgttcaagaatgatcacgaagcaagttgaatcagctcaaaagcgggttgaaggtaacaactacgattcacggaagaacgttttgcaatacgatgatgttatgagacaacagcgtgaagtgatttacggtgagcgtcgtgaagtcattgatgagcaaaaagatttgaagtgggtcatcatgccgatgatcgaacggaccatcaatcgaatcgttgatttgcatacccaaggcgaaaaagaagattgggatctgcaaaccatcttggactttgccatcagtgcgatggtcagcccagaccaaatttctctagaagatttccaaggcaaatcagctgacgaaattaagagtatgctgatggatctggcaaacaaagaatacaaagaaaagcaagaacaactctacgatgaatcacaaatgcttgaattcgaaaaggttgttatcttgcgagttgtcgattcccactggactgatcacattgacatcatggatcaattacgtcaatcaatcggtcttcgtggttatggtcaacaaaacccattggttgaatatcagcgagagggttacaagatgtttgaagaaatgattgccgatatcgaatatgacgcaacccgtctgttcatgaaggctgaaattcgtcaaaacatgcaacgttaatatgtattggaaagaatccggcaatgacgattgtttggattctttctttgaattggaacaaaattagaggagagtaatatgtcatttgaattgagtgaagcaaaaaaacaaatcgctgaaatgcaaaaagccatcgatggttttgggaggtcactttgaccttgatgccttaagtgaaagcatcgcaattaatgagtcgaagatggctgagccgggcttttgggatgaccaagaagccgctcagaaattgattgatcaaaccaatcaattaaaaaccaaacgcgacaatttcgtcggcctcaaaaataaactcgatgatctaaaagttactttggaattgatcgaagaggattctcattccgggatggagggggaatttgagactgatgaaaagcagcttaaaactaaactggaccgctaccagttgaatctgttgcttaacggcaaatatgatcataataatgccattttggaaatccatcccggagctggcggaaccgaagcccaggactggggttcgatgctgctgcgaatgtatacccgttgggcagaagcccatgggttcaccgtgcagaccttggattatcaggtcggtgacgttgccggtctgaacagtgtttcactattaatcagcggtgaaaatgcctatggttatttaaggtccgaaaaggggattcatcgattggtcaggctgtcgccatttgattcagccggtcggcgacacacgtcatttgcatccgttgatgtgatgcctgaattaaatgatgacgtctcaatcgatattaacccggatgatttacggattgatgtttatcggtccagcggtgctggtgggcaacacattaacaagacttcctccgccgttcgaatcacccatttacccactggaatcgtggctgccagtcaggcacaacgatcacaacttcaaaaccggcaaacggcaatgaacatgttgaagtcaaaattgtatgaacttgaagaagagaaaaaggccgaagaaaaggccaaaattgagggtgaacaaaaagacatcggctggggctctcaaattcgttcctatgtctttcacccatattcgatggtcaaagatcaccgaaccaattacgaaactgccaatgtcaacggcgtgatggatggtgatttggatccgttcatcaacgcctatctgcaatggcaattaagtcagaagaatccagactaatcggttattaaagccgcgtttgctttagcccggtgcgaatcaacgagaatgatacgatcaggcccttgacgccacattgcgttaagggcctttttttatcaacgacaggatgattggagaaccctaccaagcacccaaagtcagcaactgccggttaagccaccatcttgattagcctttcggatttcaaatcagcttaaatcagctgtcaataaatgatatactagccttataattattggtgaggaagacataatgaaatttttgattgcttgtggtttttatggattgcaacccgccttgtggatcggggttatccgcagttatttaattcatacgaggcggcttaagaaagagcgggggatttttaactccgccatttatgaggatttttatgaaggtcgacattttgtcagaatggggctgatctttgggatactggcctccgtcgttttaggtggctttttaagcatttcactggaatggttgatcatttatgaaggcttactgctggtttcgctcacgctgattccttggtggctgctgtcggtgactgttgccggtatcgccagtttattgacgctgggattgccaaatatatcagaattgcgaccgctgcttcattggtttgaaggactgggaatcaactcaacaactgtggccccgctcaatttgttgattttatttgtggtcattatcttggcaaacgccgttttcttgaacgttaacggtggtcgatttgattcaccgaccttggtgcgcaaccaacgaaacaataaaacggccgtttataaatttaacgaattaacgatttttccgttcctgctgtttgttcccggagactggatccataccagcttaccaatgatgccgctatttcaagtacacaatcatttctacgcgttgttattggtgccaattctgattggacttaaatttaccgtcaaaagaagtgttcccagggccttatttaaaacaatgagtcacggtatttacttactggcagggattggtgtctgcctggcaattgccggctacttcataccgcacctcattttacccgctgtggttatcctgttgttgggctactatttgattcttgggcttgccaaacaccgtgacaatcagcagtcgtttgaatatagtgaagtgatggatggtgtccgggtaattggcattcaaccggaaaccccagccgccaagatggatctcaaagttggcgatgtgatccttgaggtcaatggcatttcggtgactgatgaagattctttttatcgcgcgctcagcaccaactcaacttattgtcggttcaaagttcgcgatcgaaacgatcagttgaagatgaccgaatcggcgatcttcaagaattcacctcatgaaattggggtcaaaacatatacacagcttagtcattaggagggctatcgtgaaaaaagtgcttgtagttgacgacgaaccagcaattgttactttattggaatataacttgaagcaagccaattttgaagttcagagtgctactaacggagtcgatgcgctttcaatggctgaaaatggccaatttgacatcgtacttttggatttgatgttgcctcagatgagtggggaacaagtcctcaagcagctgcggatggaccgaaacgacacaccggtgattttattaactgccaaagataccgaatttgataaggtctttggcctcgagatgggtgctgacgattatattcccaaaccatttagtccgcgagaggtcattgcgcggattaacgcggtacttcgtcggtatgagaagagtgctgctgcatccgaaacgccagctactaaatcagctgaaaatgtcgaaaccactgggccgtttaccatcgaccacaaaaaataccgtgtgagcgctgattcgaaaaacttaaagttaacgccgaaggaatttgaattgatgcagtacttggtcagtcacgaaaatcaagtgcttagtcgtgaccaattactccagggtgtttggggctttgactactcaggtcaaagccggatggtcgatattcaaattgcccatcttcgtgaaaagatcgaaccggatccaaaacggccgaaatatctgcgaaccgttcgcggatttggttatgagttctccacgggggatgatgacgctgagtaaaatctataaacaaattttaaccgttgtaatcttaagcattgccacactggccgtgcttttttatggttttacgagcggcaatttgggctgggctgacctggccctgttattggccctggtcgatgccattgccgggattattctcatcattcaataccgccagcatgataagctgctcaaacaactccagataatgacggaaaacattgttcatcaccaaccggcggtgccgcttttcgttgaacccgacaacccactcaaaggcgttgccgaccagctcaacgaacttcaaagcaggcagcaggacgaaggaaagagtattcgaaacagcaacgctgaactaattacgattctttccagccttccagtcggggtgatggtaattgattcaactcacgatgtgattttcgccaaccataaaatgtccgtcatgctgggacgagatattttgactcaggttcatccctatacccaagacatccgcaattatcaactactgtctttaattgagaatgtttatgacagtcacaagtctcagcaagaagagattcaaagcgtcggggcgacatctgttacctgggataccagcgtggtgttcaatcaactcgaaaacgattttcacatcctggtgattatgtatgacatctcagatattattaacgtcaaacagatgcagattgactttttgcgaaatgccagtcacgaactcaagacgccgattactgccatctccggatttaccaaaactctgctgggtggggcgatggacgataagaagagtttggtggagtttttgaaaattattgatcaacaaagtgatcagctggcctcgctggttcaagacgtactgacgatttcccatattcaaaacggtactaattatcattacaaaccgttggccttgcatgatttcattgatgcggagcttgcttcatatcaatcaatgatccaaggcaaccacgttgcaattcataatcaagtcccggaacacgttgaagtcattgccgacaccaccacgctcacgcggattttacgcaatctggtcagcaacgcggttaaatataatcgcccaaatggcgaggttaacattacctatagtgacaacgacagttattggcagctccacgtttccgataccggaattgggattgcccaaaaagacatttccagattatttgaacgcttctatcgcgcagacgactcccggacgaagcagaaggtcagtgggaccggcttaggcctttcaatcgtcaaggaaatggtcgatgcagttggcggcacgattgatgttaaaagtcagcggggtgttggctcgacttttaccgtgaactttccgattgtcaaggatcgtgaccagcccaacacacaaacagactgatttttgctgaatttcaaccaaatatttacattttcaaatcaatcaagccgggagcatctccggcttttttgcgttccttcagccattaattatcaacacccggttatctatttacaaaacatttacatttgtccggtcaaatatttacattggtttaatacaatggtacttgaagattcaaggaggaattgagatgcgaaaacggacgatcgttaaactgttactgtgtgtggtggtaattgttgccggaattggtgcttacaatgcccgcagcaagacctcaaccaatcagcaatcaatcaccgctgttggttcaactgcgctccagccgctggttgaagcggccagcgaacaatattctgctgatcacgctggcattttcattaatgtccagggtggtggatctggaaccgggctgagtcaaatcgagtccggtgccgttcagatgggaaattcggatttgtttgctgaagaaaaggcggggattaatcccgccggcttggtcgatcacaaaattgctgttgtgggagtcgctccgattaccaatgaccgcgtcgggattaacaacctgagtaccgcccagttgattgcgatttttactgggaaatacaccaattggaaacagcttggcggacccgacctgccgattactttgatcaaccggtctcaggggagcggaacccgggtaacctttgaacaatatggtcttaaaggccatgaaagtgccaccgcccaggagcaggattcttcaggaactgtccgccagattgtctcatcaacgccgggggctatcagctacgtctcatttggctacttcaacaagagcattcatccattaagcgttgatgggattaagcccacggaacaaaacgtgatggacaataagtggaaaatctggtcctatgaacacatttacacccgtgggaaacccaccggattgactaaaaaattcttaacttacttgaaaaacgatcatattcaaacgaccctctttaacaaactaggttacatctctgtgaaagatatgcattaccagagaacctggcagggcaaaattacaaaaggatcgggggaataatcgtgcaaaatgaaaaattagccaaacaactgatgaaaaaatctaaaacggcccgttacgaacgatttgggcatctgctcagtctttcggcgctgctgctgattatggcgattgtgcttggcattattgtcttcgttgccagcaagggtctggccaccttcttcaaagatggtatttctgtcaaagacttctttaccggtacgttgtggaatcccggtaccaagactcccggcgggcaccaagccgtcggcgcgttgcccatgattgtcggctcttttcttgtgacgattctggctgctttactgtcgacgccgttcgccatcgggactgcggtgtatatgaccgagatttctcctaaacggggagctaaaattcttcagccggtaaccgaattactggtcggaattccctcggttgtctatggctttattggcctctcagtagtcgttcctttcgttcgaaatacgtttggcggcagtgggtttggtatcctatccgggacctttgtcctgttcgtgatgattctaccaaccattgtatcaatgactgtcgattccctcaggggcgttcccaagttctatcgccaagcctcactggccttgggtgctaccaagtggcagaccatttggaaagtcgtcttaagagccgccacaccagggattttgactgccgtggtttttggaatggccagagcctttggtgaagccttagccgttcaaatggtgattggaaatgcagctttgatgccgcaaaatttaacgtcaccggcttccacgttaacctctgttctaaccgccggcatggggaacaccgtcatgggatcgcttcaaaatgacgctctctggtcactggcactggttctgttagtcatgtcactgttctttaatttattagttcacatgatcggtcggaaaggggcgtttaagaaatgaatcgaacacaaaagcaaagccgatttgccattgcctgtttaaaagccgttgctggctttgtggtggtcatcttagcctttttgatcggctatatttttatcaccggactgcccaatatcagttggcatttcttaacgtccccggccaaagcgtttaatgccggcggcggaattggcattcagctatttaactcattttacctcttggtgttagcaatgttgatttctctgccaattgcacttggcgcggcgatttacctcaacgaatacgccaaagataactggtttaccgctacgatcaagacttcaattgaaattttgagttccttgccttctgtggtggttggactgtttggtttcttattgtttgtcgttcagttcaactatggtttctcaatcatttcaggtgcgttgactttaacgatttttaacttaccactgttaaccagaaatattgaagattcactttccaacgtttccgatgaccagcgccaaggcggtttgggcttgggactttccaaatatgagacgattattcacattgtcgttcccgcttcactgcctggaattatcagtggaatcattctttgttcgggacgggttttcggtgaggcggctgccttgatctatactgccggtcaaagcgccccagcgttgaattttgccgattggaacccctttaacattgatagcccattgtcgccgttgcggccggctgaaacattggccgttcacatttggaaaatcaactcagaaggaatcatgcctgatttgacacaggtttcctccggttcagcggctgtcctggtcctggcaattttaatctttaatttgtcggccagatggattggccggaaggtatttgaacgaatgacttcagtaaagtaggtggctgaaaatgcaaaacacaactgaattaaataacaaacccaagcggtttatttatgattttaatcccgaagaaaatgacattacgatgcagaccaaggatttggaaatctattatggcaaaactttagcaatgcacaacgcggatttgaagtttagaaaaaataccattacggccttgatcgggccttcaggatcgggtaagtcaacccttttacgggcccttaatcggatgaatgatggcgtcgccactgtgaaaggtgagattctttatcaaggcgtcaacattaatcagcccaagatcgatgtttatgaggtccggcgccgaatcgggatggtttttcaacgaccgaatccattcgccaaatcaatctatgacaacgtgactttcgcgctccagcgacgaggaattcatgataagaaaaccttggatcaagtggtggaaaccactttaaaacaagcggctgtctgggatcaggtcaaagatagtttgaataaaagtgccctttccttatccggtgggcaggcacaacgggtttgtattgccagagccttggcggttcaaccggatgtgttactgttggacgaaccggccagtgccttggacccggtttcaacgcaacaactggaagcgactttacgtgaacttaaaaaggattatacaattatcattgtgacccacaacatgcagcaggcagcccgtttgagtgactacacggtcttcttcaacatgggtgaggccattgagtacaacaaaaccagaaaggtcttcacgcggccgaaagtacagatgacagacgactatgtatcaggaaactttggttaggaggaacaatcatggcaacaccaattatttcagcagacaatttggatttattctatgatgattttcaggcactttacggaattcatttggatttcctgcctaaccaaatttctgcgctgatcggcccatcaggctgtggaaagtcaacatttctgcgttgcttgaatcgcatgaatgatatgatcgatggcgtgacaattaccggaacggttcaatttcacggagaaaatatttattctccgcaaacaaatctggtagaattgagaaagtcgattgggatggtctttcaacagcccaatccgtttccattttcagtctatgataatatcacctatggtttgcggatcgcgggacttcgtgacaaacaaaaattagatgaaattgttgaaaaaagtttgaagcaggcggctgtttgggatgaagtcaaagacaatctgtacgataacgccctgtcgttttccggcgggcagcaacagcgaatttgtatcgcccgggtgcttgccacttcaccatcagttattttgatggatgagccgaccagtgcattggacccgatttccagtgccaagattgaaaatactttgcttgagttgaaaaaagattatacaataataatcgttactcacaacctgcaacaggcttcccgaatttctgataagacagcgttctttatggaaggcagagtggttgaatatgatgacacaactaagatgttcgtgaatcctgaggaaaaacaaacggaggattacgttagcggacgattcggataggagagaagcttatggggaaagtttttgatgaagagattattacgttaaaggcggattttatgaaattgggggcactggttggtgaagccgtgaccaacgccgggcagtcgtttgtcgaccatgatattcaaaaggcggaaacggtgatcaccaacgaccacgagattaatcacctccagattcatattgaaaagcggtcatttgaaatgattgcgctgtatcagccggtcacgggggacctccgggaagtggtcggaattttaaaagccgtcactgatttggaacgagccggtgaccatgcccgaaacgtcgctcgatcggtgattgatattaaaggcaagcagcggatcgcttcagtggaagagatcattgccacaatgtctcaagaagtcagcgagcagtatgccgattcaattgagtcctacggtgatgccgatcaggacaaagccaagcggaccgcgcaacagtacgataaaaaaattgaccagctttataacgacattgcttctcccagttaccaagcgatggccaaggatccagagattgtcagttcagcgattatttatctaaacgttgccaaagatttaggccgggtgagtgattacagcacgaatatttgtgagtggacggtttatctggcaaccggaaaaattattgaattaaattaagaatggttgatattttgcactgcatacttgattgcagtgccttttttagataatcttaagctagaagttttattgtggaggcatgaggatgaatagtcataaaaaattacggcgttccagtaccaatcgggtgatttccggcgtgcttggaggaatttccgagtatctggactggaacgctgtcttggttcgaatcttgtatgtggtcttggcgtttacgcccgggatcaacgtggtcgcaattattggttatatcattatgatgttcacaattcccagtgatacacctggtagtggatcggcctttgaccaattcaaaaccaccttatccggcggaacttctaacgacaaatccagaaaagtcattcataacgtcgaagaaaaagacgttcatgatgacaagaaaaggggtcaataattgagatttttaaccaatgtcttggtcgatacgatcctgtttgttgcgatcagcggctttttccccgccaacttctacgttgccagcgtgggcattgcttttgtagcggcggtggttttagccgttttgaactggttggtccgaccgattattacgatcttgtctttgccgattaaccttttaacactgggattattcacatttgtcattaatgggttgatgcttgaactgacggcgacgattgttggggctaatttcagattctcatcattttgggtcgcaattggcgtggccattctgatgtctgcggtcagctggatcattgctgaatatttccgcaagccataaggacttgtcaggctcaaagtgataaaattatattgattaattgaggagggatgttcttgactgaaagtgtaacggttgctgatttggttaaaaacgccaggctggatgtctattatgggaaggaataccttgaagaaaggaccatttccactgctgatatttccagaccgggcctagagctaaccgggttctttaattattaccctgtcaaacgaattcagctgttgggcattactgaaatttcatattccaaggggatgtctcatgaagagctcctcgatgtgatgcagcagatgtgtcaaccacagacgccggcgttcgtggtgtccacccaactggatccgccggaagaattgctggaggccgcaaaagaacagcacattcccgtcctcggttccaaattgacgacgtctcgagttctcagtaacatgactaattacctcgacgataaattagcagaacgcaagtcgcttcacggcgttttggtcgatgtttatggattgggaatcctgattaccggtgacagtggaatcggcaagagtgaaacggcgttggaactggttaaacgtggtcaccggctgattgccgacgatcgggtagaggtttaccaacaagatgaacaaaccttgatggggaccgcccctgcgattctccgtcacttactggaaattcggggaattgggattatcgatgtgatgactttgtttggcgccggtgctgtccgcagtcagacaaaagtcgccttaattattcatctggccaactacaccaaggaagccaagtttgatcgtttgggcaacgggactcagaatgtccatatttttgatgtcgatgtgccgaaaatcacgattcccgttcgaaccggccgaaatttggcgatcatcattgaagccgctgccatgaacttccgtgcccaaagtatgggctatgacgcgactgaaacctttgaccgtaacttgaataatttaatcaaggtcaacagcaaaaacgacgaaaagcataaagaagaacaggaacatcttgaggagaaaaataaagatctcatcgatggtcgtgacaaagattcagataaaaaataggagatcgttattttgacaaatttattgagcttagccctcaacccgatcgcctttaacctgggtccaattgaagtccactggtatggtattatcattgccagtggcgtgattctggcggtttggttggcggtccgcgaaggcgataaacgtgggattaaagccgacgatatttacgatatgattttgtgggcgttgcccgctgcgctaatttgtgcgcgattgtattacgtcatcttccagtggtcttattacaaagataaccctggtgaaatcatcaaaatctgggacggtggtattgccatttatggttctttaattggtgcgatgattgtggtgatcctattttgccgccaccgcttcattccggtttggctgatgttggatgttgccgcaccaacagttattttggcacaatcaatcggccgttggggcaattttatgaatcaggaggccttcggtcaggtaacatctttgagctttctgactgggcttcatctgccacatttcatcattacccagatgtacattagcggcgcgtatcggcagccgacctttctctacgagtcgctgtggagtttcttaggctttttggtgctgataaccttgcggcacaattcccatctgtttaaacgtggcgaagtctttttaacctatgtcatgtggtattcttttggcagattctttgtcgaaggcatgcggactgacagtttgatgcttggcggccttcgggtatcgcagattctttcaatcattttatttgttggtgcaatcggaatcatcatttatcgtcgattacgccagccacataatccttggtatttagagggttccaaattaacagttaattgatcatttactaataaaggagatttatcatggctaaaaaagttgcagtgcttggtgcaggttcttgggggagtgttcttgccagtttattggacgagaatgggtcagacgtcaaattatggtcgtataacccgacacaagttaaggaacttaacgaacagcataccaacacaaaatacatcaagaatttcacgttctcagattcactggtggctaccaatgatttgaaggacgccatcgatggtgttgattacatcttattcgtggttcccacccaggtaacccgttcagttgccaaacaagttgcagaaattttggccgaccggaatcaaaaagtgaatatcatccatgcttcaaagggaattgaagaaaaaacttacttaagattatctcaagttctggctcaagaaattgatcctaagaaccgcaaatcaatttcagttctgtccggccccagccaggctgaagatgtcgtgacccatgacattactttggtcaccgttgccagtgatagcgaccaagctgccactgaaattcaaggcttgttcatgaacaactatttccgtgtttataccagtgacgacgtcattggcgtcgaaattggcgctgctttgaagaatattattgctttgggcgccggtgccttgtatgggttgggctacaaagacaacgccaaggcggccttgatgacccgtgggttagccgagatttcccgccttggaacgtcgtttggggctaacccgttgacctttatcggtttgtcgggcgttggcgatattattgtaaccgccaccagtaccaactcccgtaactggcgggctggtaacgaattaggcaagggtcattccctggatgaagtcattaataatatgggaatggtcattgagggaatcgcgacaactcgggctgcctatgaactttccaagaagcgcggtgttgaaatgccaattacttcggcaatttaccacgttttatatgatcatgctgatattaaagaaacgattaaccaactgatgacccgtgaaggccgttcagaaattgaataactcagagaaggtgaagctcactatgaccagaaaagtaaccaaagcagtcattccggctgccggtttaggaaccagatttttaccggaaaccaaggcactcccaaaggaaatgctgccgattgttgatacaccgacaattcagtttattgttgaagaagccaaacaggcggggatcaaagacattgtgattgtcatcggtaaaggcaaacgctcaatcgaagatcactttgactcgaatcccgagttggaaatgaacttggaggaacggcacaagaacgatattcttgaaaccattcgcaagaccaacgacatgaatatttacttcattcgtcagtctcatccccgtgggctgggtgatgcaatttacaccgcccgcagtttcattagcaatgaaccgtttgtggtcatgcttggtgatgacgtgatgcaggacaaagtgccactgaccaaacaattaatggaaagctaccagcagactggagcttccacattagcagtgaagaaagttgcccacaaagatatctccaaatatggggtcatcgatccctctgaagaggtccgcccaggcttgttcaacgttaaaaagttcgttgaaaagccaacgccagagaaagcgcccagcgatttagcgattattggccgctacttgttgacgcctgaaatcttcggcattttggaaaacgccaaaccggataaaactggtgaaattcaactgacatctgcaattgacaccttgaaccagacacagcgggtctttgctcatgaatttaagggtgaacgattcgataccgggaacaaattaagctggctcaaaaccaacatcatctttggcctgcgccatccggaaatttctgatggtttgcgaacttatctcaaagatttaggcgcccaattaactgaagaagacaaaaagaagtaagtgtatctactggacagacttactttttcatagtaaattaacgtgtaagtaaaatttggtaattaaagggaggatccatatggctaaacaatatgatgtcgtgattattggtgccggccccggcggcatgacagctgctctatatgcttcacgagccaacctgtcagttgcaatgatcgatcggggaatttatggcggccagatgaacaacacagctgccattgagaactatcctggttttaaatcaatcatgggtccagatctcgctcagaatatgtacgacagttcaattaactttggtgcggaatacgtttatggaaccgtcagtgctgtggaagatcacggtgactataagatcgtcaagaccgacgaagacgaaatccaagccaaagtggtcatcatcgcaaccggttccgaatataagaaattagggatccccggagaacacgaatacggtggcaaaggggtttcgtactgcgctgtctgcgatggggccttcttcaagaacaaagaagtcgtcgttgtcggcggtggagattctgcgattgaagaagcctcttacctcgctggaatcgttgatcatgtgacagttattcatcgccgtgaccaactgcgtgcccaaaaggttatccaagaccgggcattcgccaacgacaagattgattttgtttggaattccaacgtcacggaagttttgggtgacgataacaaagttaccggcgttaaagtagtcaataaccagacaaatgaagaatcagttcttgagacgtctggggtctttatttacgttggtctgctgccaatgaccgatgcttttaaagatttggacattactgatgaagatggctggattcaaaccaacgatcagatggaaacgtcaattcctggtatttatgccattggtgacgttcgacaaaaggatcttcgtcagattgcaacagctgttggcgaaggtgggattgccggtcaacaagcattcaagtatgttgaatcattggctgacacatcaaagtccagtgtttcggaacactaatttaatgattaatcaaagggaggccgcgtacaaacagttgttttgttcacggctctttttgcgaggaaaaggacggggaattatcaatgggaatgcatcagtatttggaaagtttagacgagttggaattgatcaatcgagcacctggctactttaaattcgaacagcattcggttgctgcccattcattcaaggtaactgaaattgcccaatttttaggtgacgtcgaggaaaatgccggcgaaaaagtcgactggcgcgggttgtatgaaaaagccctcaatcatgattataccgagcggtttattggtgacatcaagacgccggtcaagtatgcaacacccaagctgcgttcaatgctggctgatgtggatgataaattgacggaaaactttgtccaaaatgaaattccggatgaatttcaagatgcctaccgaagacgtctgtcggaaggcaaggatgatagtttggaaggccgtattttagcggtggccgataaagttgacctgttgtatgaatcctttggcgaaattcaaaaaggtaatcccgaggaagtctaccctgagatgtataaagagagcctctcaacgatgctggagtaccgtgatatgcattgtgttcagtatgttttgacgaaagtcattccggatatgctggccgaaaactttacgactcaggataaattaagacggctcacccgcaaagttttaaaaaaggaagacaattccaaggaataatgattggcgaaagtatgttcgtatggtaaaatagcgttgaatagtgggctgaaacaaaatatgattttgcttgcagcccttttatgttgtgtcattttggtatagaggttagggggattcaaattgattgaacgtgaagcagatcgaaaatttgatctagtatccaaatataaaccaactggtgatcagcctgatgcaatcaagaagttggtggcaggtattaacgaaggcaaaaaagcccaaattttaaaaggggctactggaactgggaagacttttaccatttccaatgtgattgcccaggtcaacaagccaactttggtcttatcgcataataaaaccttagctggccagctgtatggtgaatttaaagagttcttcccccacaatgccgttgaatattttgtaagttattatgattattatcaaccggaggcctatgtcccatccagtgacacttacattgaaaaggattcgtcgattaatgatgagattgaccagctacgccactcggcaaccagttccttactggagcgtaacgatgtcatcgtggttgcctcagtttcatcgatctttgggttgggtgatccatccgaatatcgaaatcacgttgtttcattgcgggttggccagacaattgaacgggatcattttctccgccaattagttgatattcaatatgaccgcaacgacattgattttcagcgtggtcgttttcgagttcatggggatgttgttgaagttttcccggcatcctgggatgaacatgcctttcgaattgagttttttggcgatgaaattgaccggattcgcgaagtggatactttaactggtgaagtcatcggcgatcgggatcatattgcgattttcccggcgactcactttttaaccagtgatgacgtgatgaacgttgcactaccagagattaaagacgagatggacaagcaggttgccaagtttgaaaaagaaggcaaattactggaagcacaacggttgaagcaacgaactacttacgatatcgaaatgatgcgtgaaatgggctacacgagcgggattgagaattattcacggtttatggaccgcagaaagccggggcagccgccgtttacgctgcttgacttcttccctgacgatttcttgttggtcgtcgacgaatctcaccagacaatgccgcagattcgggggatgtataatggtgaccaagctcgaaagcaacagttggtcaactacgggttccggctgccaagcgcactggacaaccggccactgacattgagcgaatttgagcagcacgtgcatcaggtggtctacatgtctgccactccggggccttatgagctggatcaaaccaaagatgtggttaaccaggtcattcgaccaaccggtttactggatccaacaattgacgtccgaccgattatggggcaaatggatgatttggttggtgaaatcaataagcgggttgacaagcacgagcgggtctttgtgaccactttgaccaagaaaatggccgaagatttaactgattatctcaaagatttggggatcaaagtgaagtatctgcattctgatattaagactcttgaacgaactcaaatcattcgcgacttgcggcttggtaagtttgacgtcttggtcggtattaacttgctgcgggaaggaattgatgttcccgaagtttccttggttgcaattttggatgccgataaggaaggcttcctccgtaatgagcgttcgttgatccaaactatcggccgggcatcccggaatgaacatggcgctgtgattatgtacgcggacaccgtgaccgattcaatgaaggcggccattgacgaaaccgctcatcgacgggccattcaaattgcttataacaagaaacatggtattacgccaaccaccatcgtcaaaccaattcgtaacttaatttcgattaccaaaggctcggatgatgccggcgaaaaggacgactttgtcgaaagtgattttgaacaaatgagtaagaaagatcaaaaggatatgctggctcgtttgacggaagaaatgcgtgacgctgccaaaaagcttgattttgagcaggctgctactttgcgtgatacaattattgaattaaagggtcaaacgagtaagtaatctaaaggagattatgcatattggcaatggataaaatcgtcattcgtggggcacgtgcccacaacttaaaaaatgtgaatgtgacaattccaaaaaataaactggttgtcatgactggcttatcgggctcggggaaaagctcgctggccttcgatacactttatgcggaaggccagcgccgatacgttgaaagtttgtcatcatacgcgcgtcaatttctggggcaaatggataagccggatgtcgattcaattgatggcttgagtccagcaatttcgattgatcaaaaaaccacttccaagaaccctaggtcgacggttggaacggtcactgaaatcaatgattattttcgactgttgtgggcccgagtgggggtaccaatctgtcccaacgacggctcggtgatttccagtcaatcagttgaccagatgatcgaccagatcatgaaactgcctgagagaacaaaattgcagattctgtcaccaatcgtacgtgggaaaaaaggtcaacacaaaaagatttttgaaaagatcaagcgtgaaggctttgttcgggtacaggttgatggcaaaacctatgatattgatgaagcaccggaactcgataaaaataagaaccatgacattaatattattattgaccgaattattgtcaaagatggcattaataaccgattgtcagattcattggaagctgctttgcgccttagtggcggttatgccgtcgctgattttttgggcgagcgcgatccactgatgttttcagaacactacgcctgcccaatttgcggattcacagtcggtgaactcgaaccacggctgttttcctttaactcaccgctgggcgcttgtcccgactgtgatggtttgggaatgaagctggaagtcgatgaagatttggtggttcctgatcgaaccaagactttggccgaaggggctctggcaccttggaattctgctagttccaaatggtatccgaatatgctcaagcaggtttgtgatgctcaaggcatcgacatggacgtgccatttaacaaactgccgaagaaacagcaaacctttgtgttatacggttcaaagaccaaatcattccattttgtcctccaaagtgactttggcggcatccgtgatgttgacggcccgtttgaaggggttgtcaataacgtcgaccggcgctatcacaacaccagcagcgactttaccagggacaatttaagtcagtatatgaccgaattaacttgtcagacctgccacggctatcgtttgaaccgtcaggcattggctgttaaggttggcaagcataacgttgcccaaatttcagctcttgatgtcacagcagaattgaacttctttaaatcgctgacatttggtgaacaggatacaatgattgccaaatcaattatcaaagaaattactgatcgactgacttttctaagaaatgttgggttggattacctgaccctctcacgttccgctcggactttatcaggcggggaagctcagcgaattcgcttggcaactcagattggttcaaatttgacgggcgttctttatattcttgacgagccctcaattgggctgcatcaacgggataatgaccgactgattgcctccctcaagaaaatgcgcgatttgggcaataccctgatcgtggtcgagcatgatgaggataccatgcgggctgccgattatatcgtcgacatcggcccgggtgccggtcagcaaggcggtcgggtaatggccgtcggaacacccgccgacattgaaaaagtaccggaatcgatcaccggccaatacctctcaggcaagcggtttattccggttccagataagcgccgcaagggaaacggtaaggaaattcgagtcactggtgctgctgagaacaacctcaaggatttgacggttgattttccgctcggcaagatggttgtgatgacaggtgtctccggctccggtaagtcgactttggtcaatgatattttgaaaaaggcccttgcccagaaactcaatcataattccgagaagccgggtaaatacaagtccatttctggttataaaaatattgaaaaaattatcgatattgaccaaacgccaatcggtcgaacaccgcgttccaacccagccacctataccggtgtgtttgacgacattcgcggcttgtttgccaataccaacgatgccaaacttcggggcttcaaaaagggccgctttagttttaacgttaagggcggtcgctgtgaaacctgtcatggtgacggcatcttgaagattgaaatgaactttctgccagacgtttacgttccttgtgaagtatgtcatggcaagcggtacaatgccgagacccttgaggttgaatacaaaggcaagaatatcgccgatgtattggacatgaccgttgacgaagccgtggactttttcagtgccatccctaaaatttctcgcaagcttcaaacaattaaagacgttggtttgggatatgttcatttgggccagccggccacaactttatctggtggggaagcccaacgaatgaagttggcttctgagctgcataagaaggccaatggccaaaacttctacattctcgatgaaccaaccaccggtcttcatagtgaggatattcggcgattattaggcgtccttcaaaagctggttgatcaaggcaataccgttttgatcattgagcacaacttggatgtcgttaagagtgccgattatctgattgatttgggaccggaaggcggcgatggtgggggaacggtcgttgcgaccgggactcccgaacagttggccaaagtccctgagagttacactggtcagtaccttaagcccgtccttgaaagggataagaaattgaccaagcaggctgaaaagcaggcagtcaaagcaagtaaataatttggttgagccatttcaatgaactgattggaagtggctcttttttgctgtctgaagttgccccattactgctagaatgctcactgggtcggggacaagtatctccgggtgtttctttcattcacatgacacacccggtatgttatactggttgaagttcgttatacgaaaggaaatcattatggctgttaacaaccaattcgtcatcatcaccggaatgagtggtgctggtaagaccgttgccatgcaaagctttgaagatttggggtatttttgcgtcgataatatgccgccaaccttgctgccaaaatttaaagaattaatccgcatggagcgggatattaataaaattgctttagtaatggatttgcggtcacaggtcttttacgatgaaatcatcgatatgtttaacgatttaaagaaaaatgatgacaataatgttgacatcatttttcttgattcatctgaccaaaaactcgtttcccgatacaaagaaacgcgtcgggctcatccgctggctcgtaatggacgcgttattgacggtattaaaaaagagcgtgaattgttggccaacgtcaaacaggctgctgacttggttgtcgataccaccaatatggcgccccggcggttacgtgaagaagttttccacaattttgaatcaactgatgaaacacatactttccacgtggaagtgatgtcgtttggtttcaaatatgggctgccgttggacgctgacattgtcatggacgtccgattcctgcccaacccatattatgatgccaaaatgcgttacaaaaccggccttgataaaccagttcgcgattatgtcatgaactcccaaggggccaaagaattttatcaaaaattattggatatgatggtcttcacactgcccggttaccaaaaggaaggcaaggccagcttaactattgcgatcggctgtaccggcgggcaacatcgttctgtggcaattgcccaacagctggcaaatgacttgaaagatcagtatccggtgaacatcacccatcgggatattgaccgccataaaacaaaggagggtaactgatgcttgacgcacttcatacgcaccaaccgcgaattgtcgtgattggtgggggaactgggctgccagttatcctcaaaaacttacgaaatcgacacgtcgacattactgcaattgtcaccgtcgccgatgatggtggttcttctggtatcttgagaaactacattaacgtcgttccgcctggcgatatccggaacgttatggtggcactatcggagatgcctgagttgtatttggatttgtttcaataccgatttcgaagttcagaccaattctttgccggtcacgctttgggcaatttgattattgcagcactttcagagatgaaaggcggtatttttgattccgtccagatattgagtgacatgctcaaggtggatggccatatttatccggctgccaacgagcccctggaattaaacgccgaatttagtgatggcacgacaatgagcggtgaatctgaaattacggctgccggcaaattgattaagcgcgtttgggtcgagacgactgatgattctcataaaccagaggcggttcatcaagtgattgatgcgattatgaacgctgatcagattgtcttgggccctggaagtctgttcaccagtattttgcccaacttaatgattgaaaacgtgggtgaagccttacgacaaaccagcgccgacatcgtctatatttgtaatatcatgactcaaaagggtgaaactgagaacttcaccgaagccgaccatgttcgggtcttgaatcgccatttagggatgaattttattaataccgttttggtgaacatcaaagaagtgccggctgaatacattgaccaccaaaaatggaatgaagtctcccagccggttaaacatgattttgccggattgcgggccatgggctgtcgggttatctcagccgattttctggaattaaaggatcgcggtgcctttcacaatggtcaagaggtcgctgacgaattgatcaatttactgggtcgatcattggacgaccataagtaggccagtcactcaagaaatggaggggattaaatgtcatacgcaagtgaggtcaaaaaggaactaacctctttgaccgttcaccgggataatgccaaggctgaattaatggccttgattcgaattaatggctccctttcaatatccaatcatcactttgtgttaaacgtttcatccgaaaatccggcaattgccaggcggatgtacaagctgctttcaaagttctacgggatcactggcgagctcagtgttcgtcgtaaaatgaagctgaaaaagaataatttatatattttacgagttgaaaataaggcaacccagctgttggatgatctgggcatttttgatggtgcttcaatcgttgaacgggttccaagtcatatgctgacagaagattcgcaaatccgctcatatctgcggggagcctttttagccagcggctctgttaataacccagaaacttccaggtatcatttggaaatctattccctgtatgaaaatcataacgaaatggttgcagaaatgatgaacaagtatcacctcaaagcccggactacgcaacggcgaagcggctacatcacttacttgaaagaggctgaaaaaattgccgactttttgcaattgatcggtgcgaccagctcgatgctgaaatttgaagatattcggattgttcgcgacatgcgcaactccgtgaatcgactggttaattgtgaaaacgccaacctcaacaaggttgccaacgctgccagtaagcagattgaaaatatcaaactgattgacgagatggtcggattaaataaactgaaccctaagctggcccaagttgcccgggcgcgcttgaaacatcccgaagtcagtttgaaagagttgggcgacttggtggagggtggaccaatttccaaatccggggttaatcaccgattgcgaaagattaacgaatatgccggcaagctggctcagggactgacccctgaagtttagttttgaccaagctagtaaagtttcaacacatttttaaacctaaaaaagattctaattatttcgctgtgaaatagttagaatcctttttgaatccaatcatttaactgttaatgacagaggttagccctcactgactcttaaaacacaggccccacgaatatcacctttggcaatatatttcagtgcctcgtcagctttggccaacggatattcagtgacctccggatggatattgagtcgatcagccaatgtcaggaactcttcaccatcccggcgggtgttgctttcgacactggtgagatttttttcatggaaaatgtgacttggataactcatttgcggaatatctgttgagtggataccggccattgccaacgtgccacctggtttcagcgcttccatggcttttggaaccacgtcacccaccggtgtgtagttgattgccgaatccagcttaacgggtggcatatcataggttcctctggctgaggccgctcccagctgcagggcaaatttcctggcatcttcaccacgggttaaaacgtgaacctcgatgccttgtttcattgcaatttgggcggttagatgagccgagccaccgaaaccatacaggcccaaggtgccgcctgcagggacgttagcccgttcatatgcccgatagccgatgattccggcgcaaagcagtggggcagccgtcagtgaatcaaaccgggccggaatccggtatgcgaagccttccggaacagtgacgtattctgcatagccgccatcatgatcccagccggtataaagtgagttggggcagagattttctctcccggaccggcaatattcacaaaccccgcaagtccaacgtaaccaaggaatcccaatccgatcgcctaatttaaatcgacgggtttcagcacccatctgaacgacccgaccaacgatttcatgaccgggcgtcaaatgttccttatgaaccggcagatcgccttcagttacatggagatccgtgtggcagaccccgcaagcgatgaccttgaccaaaacttcgcctcgttttggttttggcaccggcttggtggtgtaacgtaaaggagaaaccgcaccgttaattgaaccaggcttaacaatttcccaggccttcatctcagtggggattgattcatcagcagtttgtttaacttgttcttttgtttgattaacatccatattaatggcctcgattcatcattcatcatgttaattttttaactaacttcacctatattctagtcggtcatcaaccgattatcaatcaggtggattatgtaaaaaaagcagccctcataaaatgaggactgctttgaaaggcatcacacaattcaattaacgaattgaattactgcttttcggaactgctggtcataatgccatccaaaaggccataatcaacagcttcctgggcagtgaggtaattatcacgctcggtgtctttgttgatcttctcaattggttgaccggaattctcagctaagagattgttgatcatcttacgagctttgagaatttcttcagcagcaatttcaatttcagtttgttgaccttgagcaccaccagaaggttggtgaatcaagacttgggcatgtggcagagcaaatcgcttaccctttgctccagaagaagcaaggacagaagccattgatgcggccattcccattacgatcgtttgaacgtctgacttaacaaagttcatggtatcgtaaatggccatgcctgaggtgatcacaccaccaggtgagttgatgtagaggtaaatatctttttctgagtcttgagcatccaagaaaagtaattgggcgataatcgcattagccatgtcgtcttcgatagggcctgataacatgataattcggtcttttagcaaacgtgaataaatatcatacgcacgttcaccgcctgcggattgttcaatgacggttggcactaaattcattcaagatgcctccttataggttttatgaaagatggcttacgccaagttcatgttaatatgatagtttattggtcaaaaaaggtcaaatgttttgctcacatcaaatcattaatttttacggtcaatcttcatcagtctttgataaagaaatgcttataataagaaagcggattcattcgtgatacaataacagtaatcagcaaataccgagtcgggaggatatactatgagaactcatcatatttcactgttaaccagagatgctcaacaaaacattgatttttatacccgggttttggggatgcgcctggtaaaaaacaccgtcaatcaggaaaatatccgcattcgtcacttattctacggtgactatctcggaacaccggggtcagtggtgacattttttgtggtgccattattaggccatcggactgacggtaagcatttcttcaataatatcaaactttcgattccaaccgggagcactgatttttggaagaaacggttaaccgaccattcagtgaccgttcaagatattgaccatggtctggtattcgccgaccctgatgatgtggaagttaaattattggagacgtcagaagttttaaccgatatgcgggtggttcctgataatgggatccccgctgaaaaacaaattacgcatttaatgggaacagaactccacgtgccggatcctgaagctaccagtgcctttttccataactggttgggcattccggtagaaaataatgttgtccaattggaggacggccagtccattgaattatttgaaagtgaccagcaagatgtccggacccggtttggccggggcagtatcgatcattttgcgattcaagccccaactaacgcggccttgttcaaattctgggatattgccaaagaacagcacttaaacattgaagagtatgccgatcgtggctggttcaagagtctgtacgtccgcgatcctggtgataaccgggttgaaattgccacgacgactccggggttcagtctcgaagaacccattttgacgatggggcagggactgtcattgccaccgaaatttgagtcccaacgtcaagagatcatggacttctatgctaaagaaggcgttgattttaccgaaggtgttcgagagccaacgtccgtcccggattaaccaggggttgttgaattgcgaagaaaagattaaccatcaaaaaaagaggttcaaggattaagcttggacctctttgttgtttgtgaaatcaagccgaccattgaaaggaccaaaccgtcaagaaacatcccatgacttacctgagatattttgggacttgatttggcactccagaagcgataaatggaattgtttggcataggaacagacaccctagtcagtttgcatgaaagtgagaaagagaatgaaaattgtcgaagaaaccaaggtcagtcccaaattggtgaaggacttgttgacggtttgggagagttccgtcaaggcgacccatttatttttgacagataacgagattcaaaagattaagaaggtcattccggaagctattggcggcgtccagcatttaatcgtgattgaaaacgacaatggggatccggttggcttcatgggaattaatgaccgaatgcttgaaatgttgtttatctcaaatcaataccgtggtaagggtttgggcaaacgactattggattatgggatggagcagtattcgatcgaccagcttggtgtgaacgaacaaaacccacttgcgcgcggattttatgagcacatgggatttgaagtttacaagcgcacggaatttgatgaacagggcaatcactttccaattctgtatatgaaaaaagcggaatgacgatcaagctgattgcttacaaaaaaacagcggggcatctgcctcactgtttcgctgattaaaattgctttgtgtccactgaacctagtttcaccactaacacaattacctatgtgtcaaaaatgacctaatgaaacatgaatccttgcttgcgatgggtcagtgaaatctgatgcgcccggggggaatcgaaccctcatttcaagaaccggaatcttacgtgcgatccattacactacgggcgcaacttcctataccaatatactagaaagtgagaactttttcaagaacaaagaaaaattgattgtgaaaacgcttactaaatccatttgcattgcaattctcccgcggtctgctatactcgaatttgggtaatattttatggttactcgatgcatactttgaactttcgttcacaagggtgctgactttgttttcatttcatggtacgattaacgtgtactgtgtcttaatattttcttatttcctaaaggaggaaaacttagtatgactgtaaagattggtattaacggttttggccgaattggtcgtttggctttcaagcggatccacgaattacactccgacgagattgaagtggctgcaattaacgatttgaccactccatcaatgttggcttatttattgaagtatgattcaacccatggacgtttccctggtgatgtttcagcaactgacaagggtatcgtcgttgacggtaaagaaattcctgtttacgcagaaaaagatgcttctaaccttccttgggttaaaaatgacggtgttgactacgtacttgaatgtactggtttctacacttcagaagaaaaatcacaagctcatatcaaagctggtgcaaagcgtgtcttgatttcagcacctgctggtcaaattaagactgttgttcctggtgttaacttggatgaattgaactcaaacgatgtcatcgtttcagctggttcatgtaccactaactgcttggcaccaatggcttacttcatgaacaaagactttggtatcaaagttggtactatgacgactgttcacgcattcactgcttcacaacaaattcttgatggtcctaagactaagaagaagcgtaacaaccgtactgccagtgctaacacgattcctcattcaactggtgctgccaaggctattggtttggttatcccagatcttgccggcaaactccaaggacacgcacaacgtgttgctgtcgttgatggttcattaactgaattagttgcagtccttgacaagaaggttactgctgacgaagttaacgatgctatgaagaagcacaccgctgacaaccctgcatttggttacaacgctgacgaaattgtttcatcagatatcattgatgattcacatggttcagtatttgacccaactcaaactgaagttactactgccggtgacagccaacttgttaagactgttgcttggtacgataacgaatggggcttcacttgcaacatggttcgtaccttgttgaagttcgcttcactttaataattaattgtaattggcggaggagggtggccttctccgtcttttactatctcgctatgttctctagatcacaaatcaaatcgattttgggaggtttccaaattggcaaaattaacagtttctgatttaaatctcgaaggaaagaaagttttgatgcgtgtcgactttaacgttccgatcaaagacggcgttattggtgacgataaccgtatccaagctgctttaccaaccattaagtacgttttggaccacaaaggcaaagcaattctttgctcacatcttggccgaatcaaaaaagaagacgacaagaagggcctttcattacgcccagttgcagaacgtctttccaacttattgaacaagccggttattttcgttcccgttactgaaggtaaacagcttgaagacgctatcaacaaaatggaagacggcagtgttctcttatttgaaaacactcgttatgaagatgtcgttaatggtgaatacgtcaagcgtgaatccggtaatgatcctaaattaggtgaatactgggcttcacttgccgacgaattcattaacgatgcttttggtactgctcacagatcccacgcctcaaacgctggaatcgccgaagcaatgcacaaagacggcaagccagttgctgctggtttcttgatggaaaaagaaattcagttcttaggcgaagctgttaacaatccaaagcgcccatttgttgctattctcggtggtgccaaagtttctgataagatcggtgtgattgacaatctgctcgataaggcagacaagatcatcatcggtggtggaatgacttacacattctatgcagccaaaggaatcaagattggtgactcattgatcgaaaaagacaagattgatgttgccaagaagatccttgaaaagggtggcgacaagatcgttctcccaactgacaacgtggttgctaaagaatttaagaacgacgcagaacacaaagttgttgccggtgacattgatgacggctggatggctttggacattggtcctaagtcaattgaagactttgaaaatgttcttaaagatgctaagaccgttgtttggaacggaccgatgggtgtctttgaaatgcctaactacgcccaaggaacccttcgcattggtaagttccttggaacgttaaacgatgcgactacaattgttggtggtggtgattcaactgccgctgtcaaacaattaggcgttgctgacaaattgacccacatttcaactggtggtggtgcttcacttcaatatcttgaaggtaaaacactccctggtattgcagcaattgacaacaaataattgacgaagagcttgctatttagcgagctctttttcttttactaaaaattggtataggagaaaaatgtggcttttaaattctcttttggttacaatggcattaagctaaaaaatgtaaaggatgattcttatgagaattccgttcgttgcgggtaactggaaaatgaatttatcagtcgctgaagcagtcaaatttcttcaagccatcgagggtaaattacccgatcctaagataaccgagacctgtattgcggcttcgccactctttttggagagcatggtcgaagaaaatggtgattcaccactgattatctccgctgaaaattgtttttatgaagacgagggcgcatacaccggggagaccagccccaaagcgcttgccgaaatgggcgtgacccacgttattattggtcattcagagcgtcgtaagtactttaacgaaaccgacgacattattaataaaaaggttcacgctgcttttcgcaaccaattaacaccaatcatctgctgtgatgaaacgatgagccggcgtgaatccgctgatcgaatttcctgggtggtcagtcaagtgaccaacgcccttaaatcgattaccccgcaacaagctgagaagatcattgttgcttacgaacccagttgggcaatcggcagcggcaaaaccgccagcagcgatgaagccgaagagggttgttatttaattcgtcaaaccattgctgatttgtatggcgatgatattgccgatcaagtccgagttttgtatggcggcagtgtaaacgacgaaaacgccgatgacattctgtcacagactgatatcgacggtgttttggccggtggtgccagcttaaaaccggattcattcttaaagcttgcaaactttttacaaaaatagttaaattcgctgatttatgttgaaacttcggcgagaaactaatagaattgaagttgaaccttgtacaaaaggtcacaactttcgctaaggagagaaaaaaacatgtcaattatttctgatatttatgctcgtgaggttctagactctcgtggtaacccaactgttgaagttgaattgtatactgaagcaggtgcaatgggccgtggaatcgttccttcaggtgcttcaactggtgaacacgaagctgttgaactccgtgatggtgacaaggatcgttacatgggcaagggcgttaccaaagccgttgacaacgttaataacatcatcgctaaagaaattgttggctacgatgttactgaccaattggctattgataaggctatgatcgaattggacggtacccccaacaagggtaagttaggtgccaatgcgatcttgggtgtttcattagctgctgctcgtgctgctgctgacgaattggaagttccattgtacaactaccttggtggtttcaatggtcacttgctcccaacaccaatgttgaacgttatcaatggtggtaagcatgccaacaacaaggttgatttccaagaattcatgatcatgcctgttggtgctccaaccatcaaagaagctattcgttggagttctgaaacattccacaacttgaagaacttgttgaatgaacgcggatactcaactgccgttggtgatgaaggtggatttgctcctgacttgaagaacaacgaggaaccatttgaaatccttgttgaagctattcaacgtgcaggctacaagccaggtaaagacattgccattgcctttgactgtgcagcatcagaattctacaacaccgatactaagaaatatgatttaaagggtgacggtaagtcatacactgctgatgaatttgtgactttgcttgaaagcatcgttgacaaatacccagttatttcaatcgaggatcctcttgatgaaaacgaatgggctgattggcaaatggctactaaacgccttggtaagaaagttcaaatcgttggtgatgatttgtttgttaccaacactgattaccttaagaaaggtatcaacatgggcgttgccaatgctatcttaatcaagcttaaccaaattggtactttgactgaaactgtcgaagctgttgaaatggccaaagaagcaggctacactgcaatcatttcacaccgttctggtgaaactgaagataccacgattgctgacttggttgttggcctcaatgccggtcaaatcaagactggttcaatgagccgtggcgaacgaattgccaagtacaaccaattgatgagaattgaagaccaactcggtgacgttgccgattacaaaggaattcactcattctacaacttgtcagaacaagcacgtcaagacatcttaaacaagtaatttgaaaaaagtcgtgaaagcgactttttttgtacataaaacgcctccatttttgcgtatctaactcttagatcacaaataatggaggtattattttgaaaaaaacacttttattatcagtttcgttaggcgtgctgggattcgccagcccactggtgcatgagcagattgttggtgctgaaaccagtcaaacagctacccaggagtttcctgacaaaattaccatccaccaacagtttcaagttagaaacatccgtggtgacaagtcggtgcttgacaaacaagccacagtcaagatgtacattgataagagtaagtcgtcaacctttagtgccccggacaacgttccacattaccatccggtcgtttccgaagtgcattattctcccggaatggtggttaactatatggcagaagatgctgtggtgaccatcaagtaccttgatgaaaataaccaaccaattcaggacaacaaggttttcaatcaagcaactatctttggtacctaccgccttaataaaaacgaatttgacgtttcaggttatgaactgctcaattcaaaggatatcaacggaaaaatcaaagagaccaactgggatgtgaccctcaaatataagagccttaatccattgattgctgcggataagttggctaatgtggttgtaccagaccagccagaacctggtaattccaagtctggtgaaactgggcagacaagcgaaccaattcagctcgttagtgaaaagcccatgagcgagtctgcttcaaggccggtggtttcaacgactgcgacaactgacatgcaaccatcaccaagtacaccgagcgaggctggcaatcgtgtcgttccatccgttacccaaacagaaccagtgcaccaaccggatgtcaaaccagccgaaacgcccgataaagaagtcaaggacgctaccacttccaagtccggccccaaacatgatgataaaaaagtgaaggtagtgggtgccacaggggctgaaaacggccaattaaactcaccagtggcggcgccgggaaccaaattgccggatcctgaacccaaaacccagcccgccactaaaaccaatggggcgtcatcatcatctgataaagagactggtgccactaaacctgaaagcaaaaaggaaggcgcagttgcagattcgtcgactaatgcaaagtcgacatcatccgttcagtccgaaaccggcaaaaaatccagatcatccaagccggtagaaaccacagccgaatcactcaaccccgatgaaaaagtgcaggaaatttcaaaaacgtctgcgaagccgtctgaaaagccagccgaccttcctggtaaaaccacagatcaatccggctccacaaagaacacagttaagacttccgaatctgattcaaaagactcagaaaaaccggtcgttcaaacaaaacccaaaattccggaaatcaaccagacaaaggtacccgaaaaatcaaccgatcatcaggaaaagcaaccaatgaccacaacctatcaactccatgggatcgacactcacggccacttactcttcaataaagccctgcatctcacttcagaagaggcccgggcattccggtcaaagaacgtcgaattttatggctatgaattacagtccaccgacctggatgcaagttcgaaaaccctgacattgcattatactgctaaaaaagtcacctttaatattatcaacgtggatcaggatggcaaaaccatctctaaagactcagtggaacttgaatatggccaaaccaagacttacacggccaagtttatttcaggttatcgggttcagcaaccaacccaggaactgaaggctgacaatctgatgcctgaagatgtacaattcacttacatcaaattagccgataaatcaaacaagccattagctgaaccgactgcactcagctcaaagactggccacaaaaaagggcgtcagtcagctatcagtggccggaatccgtctgaaaccaaagcaaagcgacacaacgaagccaaagacgcttcggatgtttcagaaaagcttccccaaaccggtgaatcgcagtccgttgtcggtgttttgtcggggtggtgcttcttggcgcgttaatcggcaaaaaacttttcaaacgactcatttgattatgatatgatggatatcagaaatcattaaaggatgagcaaaattgcaggtaagaggaagttacaagctgtctcaagtaaaaacaatcgttaacgggatcgtcattggtgtactcgccggatcggcagtctcgatgtttcggtggtcaattggccatatgacggatttcatgcgctatctttatatcaattcgatccatcatctgtcgtttctactgacgacaattgtcattaatgttgccattggcttattggttggctggtttctaaagcagcagccggatattaaaggatccggcattccacaagttgaaggtcaattgttaggtgaggttgattacggctggtgggcgattctgtggcggaaatttgttggtggcattttggcgattggaagtggtttatatctcggtcgcgaaggtccctcaattcagttggggtcaactttggggcagggagttgcccatttcaccaaacaagttgggtttgatcgccaagtgctcatttccagtggtgccgctgctggcttaagtgcggcttttaacgccccaattgccagtacgctgtttgttttggaagagatttatcataacttttccaccaatatttggattgtttcgctcacatctgcggtcacttctgacatggttgcgacgtatgtttttggcctcaagccggttttatacatgcgaagtacgccactgccactcaaatattttttgtgggttgtcattttaggaattgtccttggcgtgttgggccggttatatcagatggttattcttcggatgggaaagtggtatcggcatactcatattccctggtacttcaacggaattattccgctgttgttggtgatcccaatgggagcgtttttcccgcacttgttgggtggcgggagtgacattattctgaggttgagttcggcaaattatccaactctgattttatgtctttatttcataattcggtttgttttctcgatgctttcatacgggagtggccttcccggcggcattttcctgccaattctttgccttggtggtttaatcggcgcgattgtcggcagtatcgctgtcaatcttgggttgatgaatccactgtatttctcgagtttcattattatggggatggccggatactttgcggcaatcagtaaggcccctttcacggcaattcttttgattacagagatggttgggactctgacccatctccttggcctggcggtcgtgtctttaatcgcatacggcgtcttagacctgttaaacggcaaaccggtctattactcgatgcttcagcagctcctgaaagttcagaccaagatgaatttgggtcgaactgctgaaattatggaaaccgtgtatgccggttcacagatggatggcaaaatggtgcgtcagatcaaatggccaatggggtcactgctgaccaagattcaacgaaacggtgtcgaaattgtgcctgctggcggcaccttgattcgatggggcgatacattgttcatcaacgtctcaactaaaaatcagcacgcgatcacccagcaaattattaccttaacaacagaaacttaatcccaaaaggtagcgaattctgctataatgtgttagtttagtaagagtagtattaagccgatttaacggtaggaggctatcaacgtgtacaactttttgttaacattattgctgatcgactgtgttttaattacaatcgcagtgttaatgcaaccatcaaagactaatgacgccatgtccgccttaactggtggggccgatgacttgtttgcaaagcagaagccacgtggctttgaagcattcatgcaaaaaactacacttgttttagggataattttctttctcttagcacttgcattagtttggatatcatctcattagtattcaatcctcctgtttaaatgcagggggatttttattataattgaatgggtggacatgaaaggatgggtgctatgcaaacaccagtcaaatctttttattttgaacacggaccgagagcaattattctgttgcatgcttttgccagtggcccggttgacgttcgaatgctcgcgaggtatttggagcgtcagaattataccgtgtatgcgccaatgtttactggccatgggacggctgattttaccgatatcctgattcagggaacgcccgagcgttggtggaacgatgccaaacgggccgtccagtttctaaaggacaggggatatacccaaatcagtatctttggcatctcgctgggcggtatttttgccgctaaaacgctggagaatgatccgactttactcggcggcggttcgtttggatcaccaattgttcgaaagcgtcagtttagtgttcataatacctttatgcaaatggccaaagccaattttgttcagtatgataccaatgaagcgattatgaattcaaaactcaagtggcttgacgaaaatattgatatactattaggtaagattgctgatttcacagttggtgtggcgcaggatttacctaaaatcacccaaccatacttcatcggtcaggggttaagcgatgagatcgtgaatcctgaaagtgccaagtctttgagggatggattggtgaacagtcgggtcagttaccacgaataccccaacgccagtcacatgattaccgttaatcctgctcacaagcagcttgaggctgatttaaccgaatttttaacacaactttatgaataataagaggaatatagattgcaagataatgatttgaaaaatcaaatagaaaacgttctccgaacctatccggataacgtgtttactgtcgagaaaattgctgacgtcctgagatcgcatggttcagcagcctttaagctgattgttcaagaattggcttctttggaacgcgataaagtcgccgttgtgactgaagacggcaagtttcaattgaatcctgataaacaacaattaagtggtattttccacgctaatgacaaagggtttggtttcgtcacttatgatgaaaatgctccagatgcttacattgcgcccgataacaccatgaatgcactgaatggtgatactgtggaaatggaaatcgtccggcctgcacaaccgggatccgatcggggcccggaaggcaaagtcactaaaattgccgaacacaaatatacccgcgtggttggaccgtttgaaaagactgatgatgacaaaggatacattggtcaattaaccctcagcgataagaaaattgccaagtacaaattttatatcaacgacgtcgggctgaagccaacacctggtgaagtgatcactgctcaaatcaccgaatacccatctaccaagcaccctgattacatggtggggattgccgatgaagttattggatcagttgatgacccaggaattgacattttacagattgtttatgcccatgatattcccgctgagttccctgaagatgtcattcaggctgcagatgccatcccagatcacgtgactgaagccgagaagattggccgagaagatattactgatcaggatttggtgaccatcgacggggaatcttctaaagatttggacgatgcggttaccgcttggaaactccccaatggcaattatcatttaggggttcatatcgctgacgtgagccattatgttcaacccggcagcgccattgacaaagaagcattccgtcgtgggacttccgtttatctgactgaccgtgtgattccaatgctgccaagacgtttatccaacggaatctgttcgctgaacgaaggcgaattacgattatgtatgagttgtgaaatggagattgatccatccggcaatatcatcaagcatcggattcacccgagtttgatgcgttcaaccgcccgaatgacctacacagcggttaacaacattttggaatcccacgatcaaaaaaccatggaccgttacgataaattggttcccatgtttgaaaccatgggtgagctgcacaaaattttatacaagcatcgaaaagcgcgtggggcaattgacttcgacgataacgaagcagaaattatcgtggatgacaaaggccacccaatcgatattaagctgcgggttcgtggtactgccgagcggatgattgaatcattcatgctggccgcgaacgaaacggttgccaagcactactatgaaaaacacgttccctttatttaccgggtccatgaaacgccggatgccgatcggatcagaaccttctttgagacgttgactgcattcgggattaatgtgaagggtgatccagagcatgtgaccccaaagactttacaaaatgtcttgaaaaaagttgccggcaagcctgaagaaatgatggtttcagtgatgctgctgcggagtttgaagcaggctcgttacgccgatcagtctttgggacactttgggttggcagcaccgttctatacccatttcacatcgccaattcggcgttatccagatacaatggttcatcgattgattcattattatcaagataacgggattaacgatgagaccaagaaacgttatgccaacgtgttggatgaaattgcgacgacgacttctcaatacgaacgtcgggccgttgatgccgaacgtgataccgattcaatgaagaaagctgaatatatgaacgatcacatcggcgaagaattcgatggggttgtcagttcagttatgaaatttggtctgttcattgagttgccaaatacggttgaaggcttggttcacatcagccgaatgaatgatgactactatcaatacgtggaacaatttatggccttggttggtcgaaatactcggcgaacctacaagatgggtcaggcaatccgagttaaagtggtcaatgttgacgtcaagcagagtgccgttgactttgatattgttgatcctgaaaagacgccacaaagtaacatgttgccaaagcggacttatcataataataactaccatggcaataatgagcgccacggcaattcgaataacaattcccgttccaatcacgccaacaacaaccgtgggagaaacaaccatggcaacaacggacatcggaaccataataaacattaagctgtaagcgaggtgatttgatggccaaaggcaaaaagcagcataataacgataatttgatggcgcaaaataaaaaagctcgtcatgattattcgatttccgaaacctacgaagctggaattgtgctgacaggtaccgaaattaaatcgattcgtgctcggcgaattaacctaaaggatggctttgttcaaattcgaaacgatgaggcctacatgatgaacgttcacatcagtgagtacgctgaggggaaccaatttaatcatgatccgctgcgcaatcgaaagttgttgctgcacaaaaagcaaattcgcaaattggctcaaattacccaagacaaaggggtcacaatcgttcctttaaaggtctacctcaaaaatggttttgccaaagttttaattggggtagcaaccggtaagcatgagtacgataagcgtgaaaccatcaagcgacgtgatcaaaagcgtcaaattgaacgagttatgaaacattattaatcaagctcaaacaaaaagcgatgaaatcaattggcaagctgccgactgattcatcgcttattttcattgtggagggtcgaaatgttttcactttcaagatttggtttgacgggtgctttattcaaaacacccaacttcaatcgggaagcatgtgccaacgagggatgattgagaatagccgcaatggcaagcaccaatggttcatgattggtattgtctacatccatgatccgaatgacttgatcggactgactgtatgacttgattgtcgcaatccgctggcgtccgtgcatgattcggtaagtttgtttgtcctggttaccggcaaccaaccaattaatgccgttgataaaaatcgttgtgtagtgcatcgtaaaatggatcacggaaccgcccacaaattggtccaggtaatacaaatcaaatttaggcgtcatgcccagagattgttgacggacggttgccacgacttcacctgaaattgagtaaattgaaaaagtgtcgtcaatcaagccccacttgccgacaattaaatattttgtgtctcgatattgatcggtgaccttagtcgaacgggtgtgatccagttcggttaaattcaactgtaattttcgactcatagacgcatttcctttacttgtattattttcattttaacacgttctgaaattatttacgctggtgttattttaaaaatggtatggtagaataaaacgtgaggtgttgggaatgaaaccgtttataaaaaatgactggtgggatgttttaaagcccgaattcgagaaaacttattatcagcagttacgccaatttttgatatcagaatacaagacgcaatatattcatcctgatatgaatcacatttttgaggcgtttcagctgactcctttcagcaaggtgaaggtcgtgattttgggacaggatccctatcatgagcctcatcaagcccagggattgagtttttctgtcatgccgggcgttaaaattccgccgtcacttcagaatatttataaggagcttcagtctgacctcggaatcaaaccggttgaacacggtgatttggaaagctgggccaaacagggcgtattactgctgaattcagttttgaccgttcgcaatggtcaggccttttcccacaaagggaagggttgggagcaactgactgatgcggcgatccaaaaactgtccgctcgtgagaagcccgttgtctttattctgtgggggagagctgcccgggataaaattgcgttgattgatacgaaaaccaacgtggtgattcaatcggcccatcccagtccgttgtctgctcatcgaggattctttggttcaaaaccattttcaaagaccaatgaagcactggaagcaatgggcgaggagccgattaactggcagctgccggaaaaggtatcgcaaacatcttagactgattttgtagaattggaggatttatcatggaattatttgaaagtcttaagcaaaagatcaagggcaaaaacattagtatcgttttcccagagggtgacgatgtccgaatccttggtgccgccagccgtctggcaaaggacggactggttaatccagtgattctgggggctaaagacaccgttgaaaaagttgctaaagacgctgacattgatttggggaacgttgaaattatcgactacctgaaccaaccagcggatcaaatcgatgaaatggttgcagctatcgtggaacgtcgtaagggcaagaccgatgaggccaaggcgcgcgattggctgaaggatccaaattactttggaaccacattggtctacatgaacaaaatcaacgggatggtttcaggtgccaatcatccaactggcgacacggttcgtccagctctacaaatcattaagaccaagcccggcgttaaattaatcagtggtgctttcattatgcaaaagggtgacgaacgatacttatttgccgattgtgctatcaacttggacccagatgccaatgccctggcagaaattgccgttgaaagcggcaaggttgccaagaccttcgatattgaccctaaagtggcgctgttgagcttctcgaccaaaggctctgccaagggtgatatggtcaccaaagttcaagaggcaaccaaattagctcaagaacaggcacctgatatggcaatcgatggtgaaatgcagtttgatgccgcatttgtcccaacggttgccgagaagaaggcaccgggttcaaaagttgccggtaaagctacggtctttgttttccctgaattacaatcaggcaacattggctacaagattgcccaacgcttcggtggttttgaagccattggtccaattcttcaaggattgaacaaaccggtttccgacctgtcacgaggcagcaatgaagaagacgtttataaagttgctatcatcacagcggctcaagcattataatagaaataattaaacagggtaggattgcggtggttgttgcgtcgcaatccttcctttttgaatgaggtgattaattgacgaagacgataactgttcactcagcagatcaaaccatggcgatcggtgaaaaattggccgcatacttggcgccacaagatttgattttgctcgatggtgatttgggagctgggaagaccacctttaccaaaggacttgccaaaggattggggattacgcgaccaatcaagagtcccacatttaccattattcgcgaatatcaagacggccgaattccgctgtatcacatggatgtgtaccgacttgaagaaggcggtggcgatgatctgggcttggaagaatattttaatggcgacggggtcaacgtggtcgaatggtcaaagtttgttgccgacgaactaccggatgactatcttcggattatttttcggcgggatgattctgagggcgacaacgtgagaacgctgacttttgaagccaccgggcaccgttttgaacaactaattgatgatatattttcagaataacagtggaaagcgagcaatgatgtggcagaagaagtagactttcggttagcagaaccgagtgacggtcaggcaattttggatttgttgaaggttcttcaaggcgagtccgatacgtttttggtcgattctgatttggatgacattaccgcagccgacgaagcccaacaaattaatttgatcaatcactctcggaccaatttgatggcggttgccacctatggctccgaattgattgggattgtgaccgttgacagtatcgataatggggccggtgaagtcggcgtggctgtgctggcgggttaccaaggttactcgattggcaccaacttgatggaactggccattgactgggcaacagattttagctcgcttgatcaactggtgctgactgttttctcgaagaatgagccggccattcatgtttattacaaagttggctttcacgataccgacgtgtactttcaagacggtcgtgaagttgtgagaatggccttggatgtcccaaaaaaggattgaagccttgagtgacgtggttgcttattgcaactaagaccgccacttttttattaaacggacgtgatgactggttgatctcaggcacttaatgaaataacgcaaccatccctaatcttggaatggttgcgttattttgttgaatgctgggatgaaactaagttcgttccaatctctttagattgctttgacaaatggccgcagcatttcactgccaaattgggcctgttcggttaatagaatattggcacaggcaacactatcgtccagcgcgttatggtgatgttccaaaacgatgttgagcttatcgcaaagggtgttaagtttgtgattttccaacgtcgggtagaattgcttggaggtccttaacgtgtccagtgtcaggtagtgcggcggttgaacttcataacgttccagtgttcgtttcaagacgctgttatcaaatgatgcattgtgggcaatcaccaatttattggctgaaaacagcggctgaatgtggcgccaaacttccggaaaggtcggggcatcgacaacatcacgttcatgaatgccatggacgttgatatttcgccaactaaagtccatttccggattgattaatgaataaaattcattggtaatttgattatcccgaacgatggccagggcaattgaacatgcgctggctctttttgcgtttgcggtttcaaaatccatcgcaacaaaattcatatttttcacctcaagttaatcacattgtacaaagaaccccgtgaaaacgcaaccggagtgctttccggctattccgccccatagataacttgtttcgtggtaaaattaatgtatatgttgtgaaaccgaggaattgaaaaatgatgcaatcaaaaactgttgtagatttatatcccaaaattgagattttgataaatgaacctttatccaaatacacccacacattgactggcggtccggcagatattcttgcctttcctaaatcgattaaagaatgtcaagaaatgctggattatgccaacgagcaatcgctcccggtcactgtggttggcaatgccagcaacttaatcgtcaaagacggcggcattcgtggcctgacaatgattctgaccaaaatgaaccggatttcgtcacatgaaaatgaggtcgtcgcggatgccggagctgccttgattgacgtgaccaaggctgcccaagcccattcgttaactcacttggagttcgcagcggggatccccggaagcgttggtggagcggtgttcatgaacgccggtgcttatggcggtgagatcgccaacgttgtcagtggggctgaagtcttgacacccgacaaccacattattcacttgaatcatcaagaactggatttcggttatcggcattgcagcgtccaagaaaaccagcaaatcgtcatttcggcgaccttctctttggaagtcggcattgccgacaaaattcaaaagcggatggatcatctcaatgctctgcgggcctctaaacagccgttggaactgccgtcctgtggaagtgtcttcaaacggccaaccggctattttgctggtaaactgattcatgatgccggacttcaaggcttccagatcggcggcgctcaggtttcaatgaaacatgccggctttatcgttaatgtcgatggtgccactgccactgattatttaaacgtcatcgcccatgttcaaaagaccgtttacgacaaattcggcgtgcatctggagacggaagtcagaattattggtgaagaccccaagtcaaactaggagttggtaatgcgtgcacattcttgaagcggtcattctgttaatgacgttggttgttttttccaacgttgttgaccattttgttccagcggttccggttagtttaattcaagttgttttgggactgggagccgctttaatgatgcgggtgaccattccgcttgaaactgattggttcctgttattatttatcgcgccgttgctgtttaacgacgggcgcaggttccccaagcaggagttgtggaagttgcggggaccaatattggccaatgcaattgtattggtttttttgacgacaattttaggcggcttgctgtttcacttaattattccaactatgccgttttcggtcagttttgcgctggcagcgatcctgtcgccgaccgacccggttgccgtgcagtcgatttccaaacgggcaaagcttccggaaggaattttacacattgtcagtggcgaaagcctgatcaatgatgccagcggcctgattgcctttaaatatgcaattgcagccacggtcaccggcgttttctccattaaaacggccgccattgactttgtttatatcagtattatgggcttcgtcagcggtctggtcattatggggctgattttgatgattgaaaactggctgtatcgacagggaatcaacgatgtcatttttagcacggtcctgcaggtcacaacgcctttcgtggtgtacctggtgaccgaagaattcttgcatgcttctggtgtaattgcggtggttgccgccgggatcatcttccacttttacggaacggcaccggatcgcagtcaacctgagctcaaattggtcagtgaaaaaacctgggacattattatctataccttaaacgggattgtcttcttaattctggggattgaactgccgttagcaaccaccaatgtgattcaaaataacaagattaatacctttgctgcactgggaatttcttttctagcctggctgattctcttggccattcgagttgtctggatctacgcctaccaagcggtcagcagtattcgctcccgaaaaatcaaatcaattcaaaccaagcaaatgcccacctttaaggcggcgctgttggcaggattgtctggcgttcggggggccgttaccatggccggagttttatcgattcccatgacgattgataatggcagtccgtttccgtccagatcactggcgttattcgttgctgcgggagtgatcatcatttcactggtcgtggccaccgtcaccttgccactgatttctgaagataaggcaccactgttgacccgagccaactcaaccgatgatccggatgaaattgataccagttcggccgacagcgatgcggaatacatttctgaagatgaggcccgcgtctatatcatgaaattggcagttcaacgaattgaagaagaacggcggcccaataatcaaaaagaggcttttgacttaattctcgattatcagtttctgattcgaaggctggaattaaaactccaagataaaaaagaaatggactccatcattgctgatgaattggcacttcgaagggttgcgcttcgtggtgaacgggccgcagtgcagaaattattcgacgaccaaaaaatttccaaaacggccttcttgattgccagtgccaaactgcagcgtttagaaaatcggatgatccgctcggttggtcggaaagtcaaacttgggcatgggaccgcgcggaatttcattaaactgcggaatcgcgtctccttgtggttgattcggcgcaaaacgaatgaagatatttccgatgagctggccctgattcaacgggaacaggcgaaggcggctatctcagcattatccgactactttgcccgtgacgatattgacaatcaacggtttgacagtcagtcggtttatcatttaattgtgcattatcgaaatcagattgagctggccaaggatcattccaaaaagcagatcaatgatcaggcgatgaactaccagagcttgagaattaaggccttggctgccgaacgtgaaggcgtgcaggtgctcctcgaacaaggcaatattgactggtcgatggctgcccacttaagacaatatattaactattctgaaacagttttgattatggattatcaaaacgagtagggggacttcaaatgaatgacaaagggttagtgaacttcagagacatcggcggaatcagagttccttcagggaaattgcagtcaggatacttttttagaagcggtcaaattgctgggatcagccaggaacaaacggccttcctgcaagaccagtgccggatccgggatgtttacgactttagaagtacggatgaagtcaaacaagcaccggatagtgcgatttctggtgccaaatattaccatattgatattttgtctgataaaacgtccaatggggctagtctgggggcgatgattaccgacggcaacaaggttcatgagaatatgcttaaaacttatgaatcaattgttttaagtcagtctgcccaacaggggtatcatgatttcatgacggacttgctggcagatgatgcaccgatcctatttcattgcttcgctggaaaagaccgaaccggctttgcagcggccgtgattttaaaggtggctggcgctgacgatcaacaaattatggatgattatctgctgactaatcaactgcgggtcaaggccaatgaagatttgctcaaccggttcaaaaatgaaatgaatcagcagcaattggacaacctgcacacagccttgctggttgatgccgattatttacgccacgccaacgatgttttgctggaacactttggctcatttgatgggtatttgaaaaatgggttggatctgcccagcgattatgttgcgcggtttagagaaaagttcgtgacggattgatattgaggcaaataaaaagggatgaaccgtcgaattacggtagcatcccatttattttgattgtggtttttgaatgagtttgagtgtgtagtagaataccagttgaactgccgttaataaaacaataaacacaattgccggtcggctccacatgttcaataacggtctgataaataattccggggttaagaacaagtaaatcgtgtgaatccgcaagaaacggccaatgaagatcccgattgatgccagaatggtgagcgccacaatgacggcgtgtttgaccaacagattgtgggcatggaacctggctgtaatcgcatcgccaaccttatccaagccccaaagcccgaccaaagttgagaaaatggttgaaatcaatagcagcgcaaacttgaaccacatcacatcgtcaagtcttagcaatccgttgacaccataaggattcaatagcgataagtggaataaatctgtcagcaggtagggggtatttggataaaacaacagccagacgatgatcagcacccaaaacagcaggccgtttttgggtttgccaacgtcaatgtggaagctgagttcaattggaataaatgccagaaacgtatttaacactaaaaagttaaacgggggttgttttaaatatgaatatagtagggcgatccagaccagaaagagtgcccggaccagccattttgtttttgcgttcacgttaaaaccccctatcaatatataattaaactatttttcgcgaagaaataccatcaatacttgatcgatccggtcatttttaatgttttatttaaacatcgtcacaaattttaatcgattatcagtttgacaggcgacaatgatataatatttctgaaaactaattaggggagagcgtaatgaactggtcagatatttttacgatacataacttgacgagcctgattgatattttggccgtttggtttctaatttataatttacttttgattgtccgagataccaaggcagtccagcttttgcgcgggattgtcctgatcttggtggttaaaattattagtgcttatactgggctctccactttgtcttggatcatggatcaggtgattaattggggtgttattgggctgatcgtcattttccaaccggaaattcgtcggggcctggaacaccttggccgtgggtccatttttgtcaaagggcgcaaggaaaacgaagatgctcaaaagatgatcaccgctttggatcgggcaattcaatatatgtccaaacggcgaattggggccttgattaccttacagatgaatacaggtctggaagaatatattgagactggaattgcgttggacgctgatgtgagtggtgaattgttaatcaacattttcatcccgaacaccccactccacgatggggctgtcatcattaagaataaccgggtggccgctgccgcagcttacttaccgctttctcaaagtaacctgatccccaaggaattagggacgcgtcaccgggcggccgttggaatctcggagttgacagatgcgatgacagtggttatttcagaagagaccggtgaagtgtcaatcactcaaaataacgaattactccgtgggatgacacgggatgactacctgaaatacttcaaagatcaattgtttaccgatgaagatgatcagacccaccggacatttcttagtacggtatccggctttattgacaagcatttcaaagggggacggtaatatgcgacaatggctcttaaaaaactgggcatatcgtttgctgtcgctgttctttgccatcctgttattcatgtatgttggcagtacccaatccagcacaaccagcaatcagtccggcaacaccaattcaacctcactgacctcaaaccggacccagacattttcagttccgctttctttaaccgtgaatagtaacaaatattttgtgaccggttatccgcagaaggtcaaagttcatctcaccggcccatccgcgttggtgaccaccactgcgaatacacaaaactttaaagcctacgcggacctctccaaattgggagtggggacacataccgtcaggattcagcaggacggtttaaataatgatttgagatatcgcttcgaaccagctacaattaaggttgatattcagccgcgggaaactgtttcgtatccattgaccgttaaatactctcaacgaaatattgcttcgggatatcaggcaggcgaggccaacgctgatgtgaagaacgtcaagattaccggtgcgtcagatcagattaaccggattaagtcggttgtcgctcagcttaacgttccgcaaaatgccaagtcatcaatttccagtcaggcaattattgaagccctcgacgccaaacaaaacacggttaacgtggtgattaccccggctaccgcagatgtcacgttaccaatcacgccgggcaatagtaaagaattgccgatcagactggaaccaaagggtgtcactgatgacaacgagagctttacgctgacttcggcaaccaagcgggttcgggtatttgggaccaaggcggagttggccaagctggcctctgtcaaagtcgaagtcgacaccagcgatgtcaccaagactaagaccaagcaggtgacgttggatcctaaattaaacgacgttaaaggatttgatccagagcggatttcggtcaaaatcaccagaaataactaacaaatatttaaaatatttaaactgaaatgaggaatttttaacatgaagtattttggtactgacggcgttcgcggtatcgcgaacaaagaattaacccctgagttggcctttaagtgcggccgagccggcggttatgtgctgacccaccattcagaacgtaaacagcctcaggttttggttgcacgagacacccgaatttccgggcagatgcttgaagaagccttggttgccggcctgctttcggtcggaattgaagtgttgaacctgggaatcgtcacgacacccggagttgcttacctggttagaaatcaggaagctgatgctggtgtcatgattacggcttcacacaacccggttgaatataatggtatcaagttcttcggtgccgatggttacaaattgtccgacgaactggaagaagagattgagggcatcctggaaaggccagaagacattctgccccgcccagccgccgatggcttgggagtcgttggggattatcttgaaggtagtcaaaagtatattcatttccttgagcagacaatttctgaggacctttccggcatgaaggttgccgtggacgctgccaatggttccaccagcaagctggtcaccacattgtacgccgatttgggcattgaatttgaaacgctagccactaatccagacggccttaatatcaacgatcatgttggatcaactcatccggagcagctgcagaagtttgtcttggataaaggggtttccgctggaattgcctttgatggcgacggtgaccgttgtatcgcagttgatgagaacggtaagttggttgatggtgatgctatcatgtacatttgcggtaaatacatggctgaacgtggccgcttgaagaagaataccattgtgacgaccgtcatgagtaatatggggatgtataaggcgatggaacgtgaagggatgaccagcgtgaagacccaggttggggaccgttacgtcgtcgaaaaaatgaatcaggacggctacaatttgggtggcgagcagtccggtcacatcatcttcttggatttcaacaccaccggagacggcatgctgaccagtttgcaactattatcagtcatgaaagccaccggtaagaaattgtctgaactggccggcgagatcaaaaaatatccgcaacgcttgattaacgttaaagtagccgataagaaacacgctttggacaatgacaaggttaaagacgtgatcgcccaagttgaagaagaaatgcatggtgatggccgcgtcttggttcgtcccagtgggaccgaacccctacttcgagtcatgaccgaagcaccaacacaagatttggttgatgattacaccaaacggattgcagatgttgttcgtgacgaaatgggaattgaatagtttagacattttttcagagaatcatttatttaaatatgattttaagcagatgttgtaagtaaaacgaaagtttactgcaacatctttttattttggtctcttctcaactgccaaagttgatatatcaatttttaagatttggtataccatttgacatcttttgttgacttttatctcgaagttaggtagattatacgtgttatataaatatatagagttcatattctgtatataccaatttatgaaatttgaggagaatactaaaatgtgtggaatagttggagtaactggaaatgataatgctgtttcaattttattggaagggcttgaaaaacttgaatatcgtggttatgattccgctggtatttatgtcaacgatttaaatggcaacgactatctggtgaagcgtaagggccgcatctccgaactcgaagctgccgttggaccggaagttcacggttctgtcggaatcggccacacccgctgggctacccatggggttgtgagcgttgacaatgcccatccacaatattctgaagaccaccgtttttacttggttcacaatggggtcatcgaaaactacaaggaattaaaagccaagtacttgagcaacaccacctttaccagtcaaaccgatactgaagtggttgttcaattggttgatcgatttgttcaaacagaggggatgacgactaaggaagccttcttgaagactttgagtttacttgagggatcttcatatgccttcttattgattgacagcacagatcctgaaactttgtacgttgccaagaacaagagcccacttttgatcggggttggtgacggctgcaacgtggtctgctcggacgctttggccatgctgaatgtgacccatgacttccttgaattacatgacggtgaagtggtgacaattaagcctgattcagttgacattgaagaccgtgacggccacaaggttcagcgggacactttccatgttgacatggatgctcaagagactgataaaggaccatatccttactatatgttaaaagaaattgacgagcagccaaacgtgatgcggaaattggcctccctttacactgaagaatccggcaagccaaacgttgattcacaattgatcaatgcaatgaaggaagccgatcgtttgtacattgtgggtgccggaaccagttaccatgccggactcgtcggaaagaaattattcgaaaagttagcccatgtgccaaccgaagttcacattgcttctgaatttgcctatgacaatccgctgttgtccaagaagccattctttatcttcctgtcacaaagtggtgaaactgccgacagtcgtgaagttttagtgaacgtcaatgccaataactatgagagcttgacgattaccaacgttgaaaattcaacgctcttccgcgaagcaacttacacgatgctactgcacgccggccctgagatctctgtggcctcaacgaaggcttacaccgcgcaaattggggttgaagcgattcttgccaaggcgttgggtgaagccaaagagcaaacgatcgccgaagagtttgatattcgccagcaattaggattggtcgcaaccgggatgcaggcaattattgatgagaaagatgtcatcgatgatctcgctaaaaagtattttgttccagctaaccgggccttctatattgggcggggaattgaccaaaccgtttcattggagtctgccttgaagctgaaagaaatttcatatgttcaggcagaaggctttgcatccggtgaattgaagcacggcacgattgccctgattgaagaagggacgccggttgtcggaatcattacgcaaaaacgaaccgctaatttaacccgcagcaatttgcaggaaactgaatcacggggtgcggcaacctttaccatcgttcgtaagggtttggccgaggaagatgatactttgatcattccagacgtcaatgagttgatcacaccgctgctcagcgtggtccctgcacaactgattgcttattatacaagtttgaacaagggactggatgttgatcgtccacgtaacttggctaagagtgtcactgttgagtaaatttgaatagcgtttctatagaggacaggcagagaatgcttgtcctttttgtttatcaatcattttttgatgaggcatgccatgaaacagacacatactggacaaatcgagacattgtccaaaaactttcttgatatctcaaaatggtagtttctttttttgttttcaaacagaaaatgatatattataagagttgttaaagttattaagaaagtctaaagcttctttggctaattaattctatttagggcttcattttttctctgttatctaatatgatagggatgtggcctaaacggaggtgtggatcattgaataaaataattaagcatggactaactgccttacttgttacggggatgggggttttattcacagcattttctgcccaaagtacataccaacaagcttatgcttccacagcaagcagttttatctcaaaatataaaaatgacgttaccaaagcttcatcgaagtacaacttatacgggtcggtcatgatggctcaggccggattggaaagcggctgggggcaaagtcagctgacgatcgaagccaataatttctttggaattaaaggcgcttacaacggtgcctcggtttcgatgccgacgaccgaatataatagcaatggtcagatgattaataccactgccaattttaaaaagtatccaaccgcgtacgcttcttttgccgacaatgggtccactttaagaaacggcaccagctggaaccccaagtattattccggttcttggaaagagaacgcggcaacgtatcaggacgctgcaaatgccttgactggtaaatatgcgacagcgccgggatatggtcagtcgttgattacagttatccaaacctataatttggatcagctgtttggcgagaccggggatgggtcgtcagcatcatcgtcgacctctgcttcgtcatcatctgcagcatcgagttcaacagcaagcagttcaagtgccagctcaacaactgcttcgtctgccacgacttcgacgcctacagcaccaaaacttgccaaagttaaatactacaaagcctcaggcaaagatttggtaccactttccagtaaatacaagaaatattacgtatataatcatgtgaaggggtcaaccacctctgagaaacgttatacttggtcacagctgggtgttaacagtcgggttcaagtctacctggatatgcgcggagtcaagactaacagctcaactaactggtaccgtctacgcttctatagcaatgccaaagccaaaaagttctgggttagtgctccggcattgtcatttgccacgacctattctggaacggcaactggtgcgttaacgccaagtaaaacttcctcggggtacatctataaccacattgtgggttccagctatctgtcaaaaccggttaaaaaggtaaagacgattgcggccgccaacaaaggttacaacgttaacaaaaccgcgcttcaaaagaccaccaaggggctggttctctggtatcggattgcggacggcaagacaaagggttggattaaagcttcagatgtagtatcatatcctggatcggttgcggttgtgaaccacaaggagaccaagtcgatttctaagaatgccaattcgacttatttgtacgatcatgcaaactcgacggggaatttgcagaagcattacaagctcaatcaggttgatttacaagttggcactaaggtgacagtcgataaaattggctataaggtcagcgaccattcactttggtatcgaatctcaacgcctaattcttcaaccaaatattgggtttccagtgcctttttatcataattgaatatggaaacagccgatgttgttgaccattcgtcgtaacatcggtattgggaggtttttagcatcattaagcaattcaaacatgtcatgatgaaagccctaatcgccacggttgcggttaccggcttttgttttgtccaagcaaaccactcgcatgccagcgtggaaaccgacttcattaatcagctgaaaacgccggtggtgaagattagtaaggctaaccatctctatccatccgtgatgatggcccaggcaatcgttgagagcgactttggccgttccgagctatcattggacgccaacaattacttcggggttaaaggcgcttataatggccaatctgtgactatgagtaccggggaatatacctccaagggaaagcattatatgactgcggcggcttttaaaaaatatccaagcgttgaagcctcaatcaaagataatgcttatctgttacgccacgggacattgtccgatccaaattattatgagggcacctggacgacgaacgccatttcttccagtgatgccgccatggcactgtcattaacttatgccactgatatgaattacggtaataaattaaatgcaattatcaccaagtatgatttaaacaaacttgatggatctgtcagcaccggggacattggttctaaaattgatgcctctctcaacaagcaattagctggtgactccaaaaaatcagctttaattcgagcagaaaattcacgttccaaaattaacagtattccaaagcggattattcccaactttgtttttaacgacaagggagcagtcgccatcaatcaaggcgacgccgtgatccaatttaatagtttgcctttgcagcacgttgttcgccgatagatgtttaagggttcgcaaagtttatttgggaatccttttttcagttgcaaagtttgttataatgttactcgtgaatttagtctctcttaaattaggagcggagcaatggaaaacgattataaagtaaaagttgaaaatgttaccaaagagtatgaattattcaagacgcagtctgaaaaattacgctcattcttttcgattaccaaaaaacaggttcctcatttttggtcattaatgggggtctctctgacggttaaaccaggagaaacccttggcctcatcggagttaacgggtccggaaaatcgacgatttccaatatcatttccggaattatcccccaaaccaccggttatgttgacgttcgcggggaaacttcgattgtggcaattcacgccggcttgaggagcagtttgacaggccgtgaaaacatccgtctgaaatccttgatgcaagggttaaccaatgaagaaattgacaaattaatgcctgatatcattgcgtttgccgatatcggcgattttgttgaccagccggttaagagttattcaagtggtatgcgctcccggcttgggtttgcgattgccgtccacattaacccggacattttgatcattgatgaagccttatccgttggtgatgatacattctaccaaaagtgtgtcgataaaattaccgaatttaagcaggaaggcaagacgattatctttgtcagccattctctcaaacagattgaaatgttgtgtgacaaggttgcttggatcaactatggtgaactcaaaatggttggtgacactaaagaagtcacccagaagtatcgcgagttcacgcagtggtttaagaagttaagcaaaaaagaaaaacataagtttgaaactgaacgcaagagtgttcagaaaaatttcagcattaaaaattaccaaaagcaaatcactgaacaggaacaaaatgctcacccggatgagaaggatgttcccgctaagattcataaacgtttttacggctcggtcattagcgaaaaaatgtcagtttggaatcaattattgacctgggctgtgttgattgtggtggtcttcttctgcttggttaacgtttccggccattcagtcgagcacgtgattaataatccttctgcgattgttcatccatcgcacacgcttcatctgccgggtaaagaatgactttcaggttgccagacgattgtttggcaaccttttttcgaaatttagttgacagcgctttcaatattgagtatattatgttcgggtactaaataaataccttctaatcaattctctttctctcttaaaaaactgacgtctttataacgtcagtttttttatgtataatgttcttcgtgagtaaataaggggaggtcacacgttgaagagtcatgaagtattgacactaattgaagaaattaccagaaacgatggcagcaagtatattgagatcagcaatatggtgcagaatggtcgggcagaattggcagctgagcgaggttttattaagcaggtcaggatcttacagcttaatatcccacattctcctcacgtggccaaatatgagcaatatattaacgaaaattatacgatgccgactgaagatatggatcactttgaagaatggcacaaaaccccggaaatgcagaaagaagtcgacatcattcttaaagaaaatcacattagttagtggattgatgaaatttagatgataaaatagtttgcatattttcgctggatatgatataaatatatatgtcgtttttaaagaaaatatttttgctccgtagttcagtggtagaataattgactgttaatcaagaggtcgctggttcgaacccagccggagcagtaaagatcttccggggtctgttgatcccccaaaatctttttttatgcaattttgtagttgtcagtcactcttagatatgatatattatctaagtggtcgttaagtaaatatttttgctccgtagttcagtggtagaataattgactgttaatcaagaggtcgctggttcgaacccagccggagcagttacacaaagagtaggcaatttgcctgctcttttctttttatcattttttcatttggaagtctggttatttaatctttaatctaaccaatgtcccttaagtggaatgattttctcagggcattcaaaaagacctaaccgaaaaaacttccggtcaggtcttacaacacgcaaagtaactttataagttgatttcagatggggtcgcaatgatttgccggtcaccactgtcatagacgaccagggattttggataaccattgtcgtaaggatatggtgaatcagaagttgccaccaattcatttccttgaatgaaatcataggacaaattgccatcgttattaactaaattaaatgtgatcagatttgataattggaaaacgccttgcaggtcgttatcgatgatgtaccaaacgttatcaattgcctcatcgggtaatgatgaaacgatcgtgtagctggcgaatcgggattcattgggattaaacattcataacaccttcatttctgcattgcttgtcatatgtaacctaccaaattaatcaagtcaacgcaagtaattagttagagttcaaactcttgattatcagtgattaaacggacaatgtgcttttcagttcgggcattttccggcggcagcgtcatataatcgccatagatcttggtcaagatgccatcgtagtcagctgggacccgaatataagtgtcctcaaatggcaacacaatcgtatcatttagttggtccaggctcagaatttctttttcataggcatattgtgaggcgagattcttgacgttcattaacgccgctttgtcgttatacatggtcatgacgctttcgcgttgttttttgaaatcttctgccgtctctgcctgctcggcagaaagggaggcatgaaacttgcgaattggattatcgatcacgttataacgcagtttcaaataaattcggctgtcgagtcttcgcatgtccaaaatttgccgccgttgacgggcaggagagtctggaattcgatccaaggggaagatgtccaggaaaacgcctttccgggcgttgttaacgttgttcttctcctcaatgaaggtattcctatccaatagtttggaatagctcagagcgtaattctcgtccgtccatggggtttgaagaaaatggtgagtccctttaaggtctttctcagccactttcaaaaattgctcgtaatctacccgcagcatgccgacgtccatatcatcgtcccagggaatgaacccctgatggcgaacagcccccagcattgtcccacccaaagcaatgtaatggatgtggtgttggtgggtaattttggcaaattgtttgaaaagatccagttctacttggtgaattagtgaaattgcatcatcagccataaatatcaatccttttttgttatgtcataattataaagcataatgccataaaacgataaagttaatccatttagttgcgacactggttactaaaatatataattaaggtgatataaggtttaataattaaaggggaatggtgacagatatgagtaaaacaaatcaggatctattaaaagaagcaatcgacgtttatttgtcgtcacttaaatacttagataactttgtttctgaacccgcaactaagtacggattgtcgtttgaacaatacttaattttgcatacaatcgctgaaaaacaaaacgtctcattgatggatattgccagtgaacggcgagtaacccgaagcgcaatctcgcgccaaatcaaagttctattacagcatgattatattttccaaaaaccagcggaaagtgatcgccgccgactttatttacatttaactccaaccggtgagcaaaccgaaaagcacgtcaacgatttgatcaccaaacgctttgacagctggatcagccgttatggggacgacaaggtcagagccattttgaaatttattaaggaattcgctgcagaagaaatgaatagcaaggattacaccaacaaatagcattctgggatccatctggaccggggcaaaactgaggctttgctgccggccttttatttgttgaattagttgaattcaaaagggggaacgagtatgtggatggtggctttgacaggcgtcgtttttgccgttttgacggtggctttaggtacatatttgatcaagaaccgaaacacgtcggttcttggttggctggccaatttggatttactggcattattggccctcctggttcaattatttgaggtgtttggcgaaaaatataatgcgttggtgattgccgtggccgtcgcaatcgttggtctggccgttattttgggattaattttgagttttattttctggtttatcaacgcaatcgtcgtttggcgaaaagaaggttatagtctcagcgggtcgttgacgttaatcgtcgggatcggcgttgtcctcattgatgttttgattttctttaacccaattgacctgccaacgccgattcaagcgtttgtcatgacttttttgacgatgctgattgcttatattttgctgactgtgtggaatacgttgtcttcgatgctgttgtatcaattatattttccccggagcaataaagattacatcatcgttttgggagctggattggttgatggacacaaagtcggtcgcctgcttggtggtcgcattaataaaggaatcgcattttataatcaacaaatccatcgaaccaacaagcgcgccaaattggtcttttcgggcggccagggtggtgacgagttactccctgaaagtgtcgccatgcgtgactacgccttggaacatggtgccagaggggcagacactttgattgaagaccagtcagtgaatacttttcaaaatatgaagttttcaaaagccttgattgataaagatgccggttcgactaatcatagaattgtcttcgttaccagcaattatcatactttgagagccggtatcctttctcgggaagttggtatgcatgcttttgggatcgggtcgaaaaccccattttattacctgccgaacgcagtcattcgtgaatacctggccctggttgtcatgcataagaaatttcatttggtgatgctcggcttgatgttggtcgcctcagtgattgtgggggtgctggcagggcttggaattgcttaatgtttggattgaggagttgaccgtttggttgacgccttttttgttggttcaggcaaacgtgttcccccaagcagcaacctgcacataagccaacttccggcgaaatcaaactcgatttccccgcaagtcagcttatgctccggttgctaaccgctcggactcacactctaaacgtgttcgacaagccagctttctccgcttagtccgataacagcagtcaacgcaaaaccagcgttaactactgttatcaccctaatgctccgacggcattagtgcctagtagctaatcagcttgcctcacactcttttcatcttttcttcacaccttattcacacaataagatattaattattataaaatataactatagcaagggagctataatttccacaatactatttgtagaaaggatgattatcatgtttagtttactctggacacttatcattggtggcatcattggcgcacttgcaggagcgattgccagtcgtgacatgcccatgggctggatcggcaacattgttggtggcctgattggcgcctggctcggagaagcaatttttggttcctgggggcctcaattagctgggatggcaattttaccggccattgtcggagctgttattttagtcctggtcgtttcaatggtgactcggggaatggcacgttaaggttacctcttttaagaaaggaggttgcaaattgaataagttctcaagattaatgatctggattgtcagtctgattgggattgcccaatcagtttggctggttgggttagtcattccaatcgactatttgtcaccagtcgtgactcagacaattcaaacggatactccttggatgatgattggtgccgcgattgtatccgcggtcgtcgccctagtcagtctgatgatgttgataatggcaatctttgcgccaaggaaggccgaccagctgcgatttgagtccccacacggcagactgagtatttccaagtcagcggttgaaaagattttgcagaatcgaattatgacgcaaaacaacgtcaatcatgtgactgtcaaattgcgattgaggactcggaatcgggtggttcgcgttagcgtcaacgccgttgataaactcaaccaagatctggtcaaactgggtgaggaaattcagaacaatgtcgtggatgagatccagcagttgatggatgttgaagtcaagaaagtgcgggtcaaagtgaccccgtttgaagcttcaagcagacgcgaaaaagccagtcgcccacgagtagtttaggaggaggatgtcgatgaatgcaattatgtacggagccgtcttcggaatggtcgcaggcgtcgtgtgggtctttggcggcctcagcggcatgctgacggtgttggcactgaccttgattggtgccttgatcgggaccgttatctggaagtttggcgggctcaagcgcttaatcagccaattagtgagtgatgattaaataacggaaggaaagtgagatgactgtgatggatgcaacgattcaaaaatcagatttaaacaagaagttaacctttgaaaactcggtaattgaaaaaattgccggactggtttccagaaatgtggacggggtcctgtcgcttgatggcgggatgatgagtgaattagcggatcggttctcaaaaaccactgatccgacaaaggggattgacgccgaggttggtgaaaaacaggttgccttggacatggaagctacgattgaatatggcgccgacgcccggcagatctttgatgaaatttgcagccggacccaaaaagccatcaagaattataccggtttggacgttgttgaaattaatttaaatattaacgatgttctgaccaaaaaagaatgggaacagcaaagtacccgaaagaaagacgatatcgcaaacactgtcaatgatgacagggtggaatagccaatggagggaaaaaccatgacacaagaaaacagcagtgtagcaaccgtattaacttatgatgacagtgtgttaaccaagattgccggtaataccgttcgtgatgtggatggggtgctgtctttagaggggaacctgattgattcggtcactgatcgtttcagtgacgagacggatccctcaactggggtgaaagtagatttagacaacgatgataaagaagttaaattggcaatggatgcagtcttggaatatggcaaatgcatcccaacggtctttaacaaaattaccactaaattaactcagacaatcaccgaaatgaccgatttgaagccaaccgaaattaaaattcacgtgaaggatttacagacacgggatgaatttctaaaaaagaaccagaaaaaagataagggtgagaagaaaaaataattaaagaccattttgatcaaccagacagcaaaggggctgcgacagatttgtcgcagccccttgtggttgtcgtcttaactatgcgattgttttcgattcaggatctttttgattgtcagcatgatggttaagccaattgctaacaccgccaaagtgattgcgaacggacggttgttggttacggtcatcaaaataaaaccaatcgcgatggtgatcaacatggaaatatcaaaatgagacattttgccacctcacttactaagccatggcctcgtcttcctcaagctccaaccaaagggccagcgccgttgggttgaagtccggccaactggaaatatgttcatatccgcgcgccaaaagcgagctttgctttcgttttttaaggtcatcaaaaatcgttaatgcaaacaggttatcttcaaggtcggtgataacggttcccaatttgtgctgccactcggcaaccaggtcctggtagatcaataatttccgggcattcttgattgtatagtcgaccccttgatcccgcagggtttgtttataatcttcatactcttgcaaaacagattctttagcggtttcccactggtcattattgtatctggacactttattagccattgtcgttcctccctagtccaaaataaattcacaaacactaagaagatggtcacaaaacaatcgtttcatcccatcttcgatcgaaaatatattttgtctactgaagaacattaaacactaaatcgggaaattttgcaaagcaactcgccattaatcttccacagtcgctcccagaacatgttcgaagtgatccaatgcccagtcattgccggcttgggtcaatccggcaacgccgcttttgtgaacgacaatgttgtagcagagattataagcgtcgacggcagtgtgtaaaacgcagatatcgctgcagacaccgactagatgaacggtgtcaacgtggcgttcacgcagccggatatccaggtcggtgccggcaaaggcactgtagcgggttttgtcatacatatacaccttatcatctgcttgatgctctttaaaccaaggtgataagccaccataaaattcacggccccaagtacctcggacgttgtgaggtgggaataacttggtttcaggatggtatggatcatttggtgtatgcacatcggtcggtaaaatcacccagtcgccattggccacaaattcgtcagctaattttaagatatgcggttcaagtacctgtccagggccgccacagctcagcgcccctttatcggccacaaaatcgttggtataatcaataatcagtaaagctgtatgagattccataaatgtatccctccataaagactcgattaaaagtctgattaacttttattggctcaaagatactcgatattggccgaaaaatcaactaatttgctgatttaatttcgtctttgttcttcatctgtgaacatgtgttgacgatttggggttgacatttaaaatatgaaccgtatactggtaaatattcacagagagctggcatttgctgaaagccagcaactaaaatggcaatacttaatggcggcagccttatctgcaataagaggcaatacatattgtattgtggaacttgggtggaaccgcgttgaagaacgcccctggtactgtaataggtactgggggcgtttttaatggacatttttaaggaggacactatggaaacgaaggatcaaacaaattcactatcgcgttcactaaaaagccgacacattcagatgattgcgattggcggggcaattggaaccgggctgttcttggggtccggttcggccattcacacttcagggccatcaatcattttatcctacttgattgtcgggatcttttgtttcctgctgatgcgggggattggtgaattgctgctgtcagataccagcaaacattcatttcttgattttgtaaaaatgtatttgggtgaccgctgggagtttgtgaccggctggacttactggttctgctggattagtttggcaatggccgatttgactgccaccggaatttatatcaagttttggtttcccggagttccccaatggattccaccgctgattattctcttatgtctgttcgccgccaatctggtcaatgtcggattgtttggtgagatggaatcctggttttcgatgattaaagtcgtggcaattattctcctagtcgtggtcggagtaggactcgccgtgttccatgtaaatgttgacggctcgacggcttcgttcagccagctggtcagccatggcggctttttcccaactggcgcccacgggttcttgatgtcatttcaaatggtggtgtttgcctttgtcggcattgaaatggttgggttgacggccggcgaaactgacgatcccaaagccaatctgccaaaggcgattaacagcttaccaattagaattggtttattttatattggctcgatgattgcggtcatgagtgtttacccttggaataaaatcaccacgaccgccagcccattcgttcaggtgttctcgggagtgggaattgtgggggctgccgggattttgaattttgttgttttgactgccgcagtctccgccactaacagttgtttattcagtaccagccggacgatgtacgcgttgagtatgggtgggaatgcttcgtcatttttaaccaaattggggcgcaacggcgttccaaacattgccctgaacttctcaaccgcctttctgttaatcatcgttgttttgaactactttattccagcaggggtcttcaacctggtttcaagtgtttcaaccattaactttgtcgtggtgtgggtggttttaatcattgtccacattaaatatcgccgagctcatccgaagggcagtgaggtctttaaaatgcctgggtatccgttgagtgattatttgacactggcattctttgtcttcattcttggattcctattggtgaacagctcaacgcgggtggcgatggtcatttccttgatttcaattggctcgatgctggtaatttaccaggtgatccaacggcgtcatggcggcaggtagttggggattgaaattgctttcggaaaaaattagactttagttattcataaaatgacgattgaagaggcaattccatgattaaaattcataagtttgacacttacacctgggtcgaggcaatttcaccaactgaagacgaattaaatgacattacgattgactatcgggcaccagccaagttcaaaggctatatgctggatcgtcatgagcagccacgggccacttttgatgatctgtcagggtttagtgcactggtggtcagggcaattgcggatcctaagcaaagccgaatgctcacatcgccgatttttctgggattcagtaattccctgctgattacggtgtgtcacgcccaagagcaggctaagctggtttcagaccattccaagttggcatatgacagtgttgccgagcacattttggcaatcctgtttgcattgatttcgccgttctttgacaaattggacgagatcagtcagaaagccgagaagttggaagggatgcacaaccgggcaatcagcaaccacagtttggatgaattggcagcactaaagaccagtctggtctatctgcgctcggccacggcaggcaacttgatcgccctgcaggagttacaagccaccatcaaggataacttgaagatgtcccccgaacttgccagcaaaaccaatgaatccattggtgacctgttaattgaatacaaacagtgtcaaaccatgtttgatgtggtcggcgacgtggttcgggaaaccgagtcggcatttgggaatattttgaataataaattgaaccaaacgatgcagtttctgacgatttggtcactgattctagccattccgccgattgtttccgggttttatgggatgaacgttaaactaccatttgcaggtcgtggggaagcttggttctatacagtcgttttaacgatggtaatggtcttattgatgattgtgtatattaagaaggatcgccgcttcaagaaatagaacatagctgaaagccgcttcgtggatttttcggtatacaaaaagctcgtcattcaagatgacgggctttttgtatgatgcaatttgcaaataccgacgggtaagtttcacgactacatcgcaaaaacgtgcttgccggaatcatatcgtttgagtgcgttcacagcctcagtaatgttacctcgtaaaatatcattatggtcaatgtcgattattttaaagttcatcagcagttcgtcggggagatcatcgatgatgcgcctgtccatcaaaatgatgtcggcacatggcttggtagcatcgaagaaatggtcgggaataatatcaacggatggttgcagtgaatttaatttttctttgagtcgatcacaaaaatgttgaatgaggacatcgtcaacaatgggattcccagttaatgagggttgtattttgcctactcggatatcaccaactactttaatgttcacgcttgtcaccgtccttgtcgaatttatcaatcaacgccatactacacgattgaatgaaggtgggtgacaaagttggtgattcttttcttaaaattaaccatattaacaaaattataataaatgaaccttaaaaacagaccagcattgaaaacaacaggaaggaaaccgtcgaaacattggcccgtttttcaaaattacggaaattaacccgggattcaaaataagcgtagaatgccagaatgccagcgataagaatgattttaacaaatgagatgttgagtgtgagacacaacattaaaatcagcaccgacacgatcattatggacagctgattgttttgcttcataaaggcgtagtaggaaaagaaaatattcgcgaaaatcatcagggtgatatacatcagtgagaccagcgaaaaatagtgatggtaggtcgttgtgaacaacaagacaattccggttccggaaatgaacccataaataatccaacgacagtgaggttcatcgattaaattagagactaacagcaggttggcgagcaaaaagccgatcagaatcagccagacgttaatgcttggcgtatcgaggtacagcgacgccaataagatacccagcaaaatatcggttaagatgatcatgacggcatttttgcgtggtcggctaacaacggtcaataaaacggcaaacacgaacccgatcaccaagagatgcagaagacgcggattgacgaaaaatccctttaacgagatattggcaaatagcatccagataaagaccatgctgacggcgcgcagtcctgattgaattaaaatggagcggtcaaattttaacaaatcctcaacttcctcacatttttaatagctaattataaaaataatcctactggttttctgtcagatggtcaatggacagctgaaaataaggcttgaaaagcaaatcaaatatgataagattgtagagttatgagttcccgataggattcacgtgatgcgtgaagaagccttgtaaccttaaaaaataatagggggaaaatagaatgcgcgaaaaacatttatttacttcggaatcagtttcagaaggccatccggataaaattgcggatcagattagtgatgcaattctggatgccttgttagcaaaagacccggatgctcgggtagcatgcgaaacctcagtcaccaccggactggtgtttgttttcggtgaaatttccacgactgcttatgtggatattcaaaaagtcgttcgcaacacgattaagcgaatcggctatgccgatggccgttacggctttgatggtgattcatgtggtgttatcgttgcccttgatggtcaatcacctgatattgccttaggtgttgatgacgctttggagcaacgtgaaggcaataccgacccgttggatcaaatcggtgccggtgaccaaggcctcatgtttggctatgccattgatgagacacccgagttaatgccgttgccgatttcattagcccacaagctgatgagaaagcaggcagacttgcgtaagagtggcgagattggttatctgggaccggatgccaaggctgaagtcaccgttgagtatgatgacaacgccaagccggtccgagttgacacggtcgtcttaagcactcagcatgacgatggtgtccgattggatcaagttcggaccgatgtgatcaaccaaatcatcaaacaggtgattcctgccaagtatcttgacgacaagacccgttatctggttaatccaaccggccggtttgtcattggtggtcctcaaggggatgccgggttaaccggacgtaagattatcgttgatacctatggtggttacgcccaccatggtggcggtgccttttcaggaaaggatgctaccaaagttgaccgttcggcgagttatgcggcgcgatacattgctaagaacattgttgccgccggtttggcaagcgaagctgaaatccagttggcatatgccatcggggttgccaagcccgtttcaatcgacattaatacatttggtaccggtaaagtgcctgaagatcaattgattgatgccacgcgagcattatttgatcttcgcccggcaggaattatcaaaatgctggacttaaaacgaccaatttatgaacagaccgcagcgtatggtcactttggaagaaccgatattgatcttccatgggagcataccgataaggttgatgcgttaaaagactatttcaagttataaacagctgacaagcaaaacgcccttgaaaattcaagggcatttttttgtttaattttaaagaaaagaggtcatttcatgacgaaaacagcaaccaaaagtaatgtaaccttagtaacgattgccctctttgtggccacctttatggccgcaattgaagggacaattgtttcgactgccatgccgacgattgtcggtgacctgcggggagtttccctaatgaattgggtcttttccatttttctgttaaccaatgcaattgcgacgccaatctatggtaaattggccgacagtattggccgaaagccaatgtttattggcgggattttgatctttgtctttgggtcggtgatgtccgggttatcgcactcgatggtggttttgatcttttggcgggcggttcaaggggttggagccggctccatcatgccgatttccaatacgattatcgccgatatttatcccctggaaaagcgcgctcaggtgttgggcctgaactcgtctgcttggggaattgcttctgtgatcgcgccactattaggtggtttcattgttgatcacttgagctggcactggattttctttatcaatttaccaattgggctgattgtcatgttcatggtccaaatttttctgcatgaagacaaacaccacagtaccactaaaatggacattgccgggacgacttggctgacgatgatgctgttggcagttatgtatgcgttccagttggtcggccaggatccgatcaactggcagatcgttgcggtctgcttcttggttacagtgatcgccaccgtcatgtttattcggacagaaagactggcggccgatccgttaattccgatggaactatttgataatcggaccttcgtcgttcaaaatatcgtggtttttttggtcagtggctttctgatcggctacgaagtttatctgccggactggacccagggaattttgggcctgcgggcatcgatggccgggtttgcggtgacgccgagttccctgatgtggattgtcggctcatttttggccggtaaattgctggccaggacgtcaccttaccgcattattaacctcagtctcttctttatcttggttggggccattattatggtgctgattccggcatatacgccgtttgtggccttcttggggatttcaatgatctgtgggaccggctttggcttaacggtgacaacgtcgattattagcgttcaaaatgaggttaaaccaactcagattggtgtggcaacttcctttaatactttgtgccgaacgctgggtcagacactgatgatttcaatctttggtatcgtcatgaacaccaccatgctgcgtggggttcggcaaacggaacatacgtccttgaaaatgatggacaaactgattaacccattgactgccaatcagttaagtgacaaaattttgccgcagttgcgaaatattttgtacaattccctgcataatgtctttgtggtcggcctgattctgattatcattgcctatatctgcaatttgtttgaccgcaaaaataaaaaacagcgaatcaattaatcgatccgctgaatcgccatcaatattggtggaaaatgctgctgatttaagaagctgtatttcaaaacactgtatcgtttttggtcgagttgactgccaaattcgaggacggtgtttttttcgcgttcgccgcctgggtgaccgtagtaggcaaccacgacgatcacgccattatggcacaaatggttgaggcagcctttaatcgccgcaatcgtcgtttcagggtaggtgacaatcgtcttatcgccgcccggcagatagccgagattgaagatggcgccggaaatcatggtctcgtatggtaaaatttcatcaactttggcatgactgatattgtacaggtagacatttttggtgcgaacgtgattggtttttagaagtgctttggtattttcaactgcctgggcttgaatatcaaatccatacacggtgccttgtttgccaactaaattggctaaaaacagggtgtcgtgaccgttacccatggtacagtcaacgacggtatctccggaatcgacagtttctgataacagttcatggctatattccaatgctgatttgattttcatgagatacctcctgcgaatcgattaaatacccattgtgacaccattaaggtcactaggccaagactccagccacccagaacgtcactggcataatgaacgccaacatatatccggctgataccgataccgacaatcatgatgatcaaaatcagatcaacgatcagccgttggctacttcctttaagcatgcggttggccagcaaaatcaggctgccggcaaccaccatgatactcattgagtgaccactggggaaactactgctgtgaacagccaccagatgggtcagggatggtcgcggccggttaaccatgtgtttgaccagggtatcaattggggctgccaagacgacgccgttaatcaacaggaataaggctgacttgattttgcgaaccaaaaataaaatcaaaccggcaccgattgtgaaccccaatagtgactgataatttcccagctcggtaaaatgaatcatgaagctggttagcgagggcgtttgaaagcttctgaccatgtggccgaagtaggtgtcaaaggtattgatccattctttatgtaagacgacgccgtaagtcagaaccaaaaagatgaccagtgaaaccaaactaacggtgcttgaaattttttgtgattgttttttcatgttttcaactccaataataaaattatagcacgctgagcagttgttttttaagacctgttttggtatgataataagcaataatttcaatttgtgaaaatgcagagacgaattagtaaccaactgcctgttttccagaaactgagtggctgctgtgaactcagaacaggtcgtggcgaactcatcgtcgaatgcttggtcgaacgaagtaaatcaagccggtttgtcgccgttattgattcgagagctcaagtaattgagaatataggtggtaccgcgataaatcgtcctataagaagcccagtctggtttcttatgggacttttttcattgattgagaaatatgaaaggtggaagttgcaaaatggcatacaatcatgaggtaattgagcgcaaatggcagcattactggaaagaacacaagacatttaagactgaagaagttgctgacaaagacaaatactatgtcttggatatgttcccttatccatcgggtcagggcctgcacgttgggcatcctgaaggctacacagctacggatattatggctagaatgaagcggatgcaggggaaaaatgttcttcacccaatgggatgggatgcttttggattacctgcagaacagtatgcattgaagacggggcataacccgcgggactttacagctaagaacatcaaaactttcaaacgccaaattcgttcacttggattctcatatgattgggatcgtgaaattaacaccaccgacccaagttattacaaatggacccaatggatttttgaagaattatacaaacgcggattggcttatgaagacaatattgaagttaactgggcccctgattttatgggtgggaccgttgttgccaacgaggaagtcgttgacggtaagactgaacgtggcggctatccggtttatcgggtgccgatgcgccaatgggtcctcaagatcacggcttacgctgatcgattgattgatgacttggacgacctggattggcctgaaagtattaaggaacaacaacgcaactggatcggccgctcgcgtggtgccagcgtgttctttgaggtcaaaggtcatcctgatgacaaggttgaagtgttcaccacccgtcctgacaccctgtttggggcaacttacatggtgctggctccggaacacgagctggtttcaaagattaccacccctgaacaagcagctgaagtcaaagcttatcaagaagaagtttcccgcaaatccgatcttgaacgaaccgatttgaacaaagataagagtggggtcttcactggtgcctatgggattaatccaatgactggtaaagaagtgccaatctggattggcgattacgttcttgaatcatacggaaccggtgccatcatggccgttccagcccatgatgatcgtgattatgactttgccaagaaatttggactgccgattgttcctgtcattgaaggtggtaataccgacgaagctgcctatacgggtgacggttctcacttcaactccggcttcatggatggcatgggcaaagatgacgccattaaggcagccatcgattggttaactgatcataaagccggtcatgaaaaggtcaactaccggctgcgtgactggattttcagccgtcaacgatactggggtgaaccaattccagtaattcattgggaagatggcgaaacgacgctggttcctgaagatgagctgccgcttcgattgccaaaggccaaagatattcaaacctctggtggcaaggaaagcccactcgctaacttggatgactgggtcaacgtggttgataaaaacggccgtaaaggcaaacgtgaaaccaacacgatgccacagtgggccggtagttcatggtactggctgcgttacatggatccccataacgaccaggcgatcgcttcgcctgaaaagttgaagtactggtcaccagtcgacttatacgtcggcggggctgaacatgccgttctacatttgctatatgcaagattctggcacaagttcctttacgatttgggggttgtgccaaccaaggaaccgttccagaaactggttaaccaggggatgattcttggaaccaaccacgaaaagatgtcgaagtcaaagggtaacgtgatcaacccggatgatattgttgatgaatatggtgcagatacacttcgggtatatgaaatgttcatgggcccaatcgatgctgccaagccttggagcacggaaggcattcacggggcctaccattggcttgaccgggtatggcgattgctgatcgacgataacaaccatcttcgtgaccgcgtcaccacgatcaacgacggcaagctggacaagatttataaccagacggttaaaatcgtttcagatgattttgaacatatgcggtttaacgtcggcatttctcaaatgatggtctttgttaacgacgcctacaaggcagattcactgccaattgattacatggaaggcttcgtcaaactcctgtcaccggttgccccacatattgcagaagaattgtggagtctattgggtcatgacggcacgattacctatgaaaaatggccaacgtatgatgcttccaagttagttgaaaatactgttcagatggtcgttcaagtcaacgggaaagttcgttcacacattaaggtagcccgtgatcttgataaagacaaagttgaacaaactgccaaaagtgatgagaatgttgaacgctatctggaaggcaagactgttcgcaaagtgattgtcattccaaacaagatcgttaatattgttgtcggttaacgtgatcaagcaaacagctggggaattgtcctcagctgtttttgatttgaacagttgaattattttcaaaaaaataaaaacattccgccattttctccgtatatatattacgaacgggacgagttaagtcgtcttgaaaaatgttgaaggagaaagatgatggataaatttgataaagtgacttgggggaaagctaatagtcttaaattttggagcagtttagtgctcatggctgccagtgggttaatcatgctgcaggcaccgttagctcacgcggattccccagcagcgaacatgcgcacgactgagttgggacagcgggtgacattttatgttcagccggtgtaccaatccgatcccagtggtgactggcaggtgattcccggagtcaagccaattaagatggtcggcaatgtagggggatcctttcaagtaccggtttataagaactttgttccaaccacaacgatttctcatacagttccagattttcgtgcagacttgcagcacccgttgctgctcaaatacagtcaggaaagtaccggcctctataccgcaacggtgaatattaactatatgaatcgtcaagatagtcacacactggacagtgccaccaaaacgttgcattacgctgaccaagtaaccattaagccgaagaaaattcagggatatcagccggttgaggcaacctttgaaagcccatatttcactaaaaataacgatcaatcggtaaacttttgttttagagaattaagggatctgacttgcctggtaaaattctggtaccagccagtgaatgcttctcagccagatcaggccgagcaggtcaaagaaacccggccaaagcagaaccatgctgaggggtctacgaattctcacgcaggcaccgattcaaaacttgtggaagctgccaaaccggtgacacaagacagtggcgacacaaagccagccagttcgaatgtagcgccggtattaccagtcaactcaactgatcaggcgcaaaaaagtgctccccaagttgaagttaagcaacaacggcccacggttcctcaaccaactttaataactaaagaaccggtgtttcaggcggctaaacctgtcgagacgaaagctgcaagtcttccgtcagatttgtcccaggttgcacaacaatcgccagtggtcccgtcaaaaccaacgaattcgacgagggttaatgtggcgggaaaaagtcaaatctctgttagtcggccaacagagagtgtccgcacgtcatcccggccagcgactgattcccacctgggagcaaccggggtcgcaattttgaacaactcgacgcatgtaggccaagctacaataacccaaccgactccaaacaaaaaagtcgccgtaaaagggatggccgtctacgccatcaaaacggtcgggctatacagttcccccaattttaaggccgtcaatcgacttttccgatatccagctcaaaagcgctatgcccgacccatgtttgtagtaaccggctacgctcgttcagctactggtaagttgcggtaccgggtacgggatgtcaatcatcaaagcccttcccatggcaaaacaggctacctaacggcaaactggacctatgtgagaccagtctattacgccagtcgtcacccaaaaatcaaagtgatcaacccgaccggcattcatggctatcaaggtaagaatttgactggtagagttgccacctacaaaatgggccagactgtcaatgtcaaacgcatggttcattatcacttgacaacgcgttttgtcttagccgatggttcatatatcacagctaatcgtaaattagtgagtgcctttaaataatcaactacatgaatgaaaaacagccaaaatccgaaatggattttggctgtttttgagttgctattgcattaattcactcgcagaactatcctggtaatttttattccacaggaattccgttagaattttattgacggcaatgttgttattgtgcagggcactgtgttgcgcctttggaccaaaagcttgaaatgtttgataaaaactgacatgatctcgcaaaatataacccaatgatagggcagaagtgttagtgaccacgccatctgaatttgaaccatcgcccaagttaccatagatattcaaaaccctggcttgacgaggaaaattttttctcagccgatagagtaacttgtattcaggatggatgatcttgggtttaccagtcggcaaaatgcgatttttgttgggcgcatcatcccataactgcatcagtggacctgatgtcggctgattagatttgtgattatccattatcccatcataaggcccggcgatcacacataacttattggttcgcggcaaatcagaccggttgccgttcaaaaggttatagtagattaccgcgtaagcccccatggaatggccgacaaagtttaattgattgacatggtatttctgcttgagtaacttgcagaccttggtcagccagcgagcatactgaacctcgccggcgcggttattgtccattcggaccataatgattggattcaccatccatgacttaacggttccagtgactgacaattttccgttggctctcacgcggacaatcattcgccttgaagcggcgccactgacctctgccgcggagatcatatctttttcggaacgaagggtggccccccagccgtggacaaagatagtcggcgtactggagtcaatatagttggccttgagctgatccgaagcacgctgatcctgccaaatgttaaaaccgaagcccaagatgatgagcccgccgattacaaagtaaagtattcgcaagtttcttgagcgccgataatttatcaactaattgaccgccttatacgtgaattctttattttttgtttgacatagccgtagccaagtgacaggataaacgaaattaaaaccgccagaattgtttccataatggcaccattgtagccagcttcatcgatgatatcgatgacggccttgtgcagatacataattcccaatgtctgttggcccaataattgaaccggcttaatgaggaactggggcatgaatttgcagaaatagtaactggcgctgaaaacgactaaacaaacaataatcgggataaaagtaatgtaggaaacccgagaaattggaatgtgatgataggaagcgtgaatgattttggacttcaggaagaacgcgaagttgaaccggtccatgtgctgcatccaaaacaaccagacggtaagcatggctgctggaataatcacccacaggtccttaacgaattgctgaattttgtggaaataaagatagccaaataacatgaagaacatggcgataaaagcaacatcgaagtcccagggaacgtatttataacttaggaagtaaatgtgcttgtaactggtggaaatgattaatgaagcaaaggccacaataatctgtgcttcccggcttttgacgtatgtaatgacaatcgatgtgaaaaccagggccaacaggtaaacattaatgtaccaaaaaacactgaggtagtggttcagtgtccgtccaccatacagtaatcgggcaaagtagaagatcgtgtacgaccaactttcacctctgatgaagtgtgacagtaaaatcaaaaagccaccacagattaaatatgaaattagcagtggtaaaatccgtttcttgaaaaaaccgatccaattgttattgacgattggctttaagaaaaagccccccatgatgaagaagatcggcatgtgccaccaataaagaaaatggaacatggtgccgtgtcgtgtcatggcgtgaccgaaaacaacggcgacaattccgaccgctttggcaacgtcaatccactcgattctttttttactcacaagtgtttcacctcgaaaattattaagaccacatataaaaatattctagtgcatttagggtgttcatgacaatactttttcattacatctctataaaacaattgatgcttaagtaatttttaatatatcaccccgttattgctattcattagcaacttgattaaaatgaagcgagtgtcaaagtatacgaaagtaggaacaatcatgattgataatcatcaaaacctgacggaaaagtcgcgtgaccagatgttatccgggtcagcgtggatgacggccggtagtattttgagtcgatttctcggtgcagtctatattattccctgggggatttggtttggcaattatttcttccaagccaacgcgctgtacggactcgggtataacatttacagtttcttcttgattgccgccattgccgggattccctcggcgatcgccaaacaagtggctcattacaatgccttaaatgagtatggtgtcggcgttcggctttataaacggggcttggtgttggccattgctacaggagttatctgtgcggtgatcctgtattttggtgcgcccttaattgacggcggcaatcccaacgtcattccggttttgcattcattggcatgggcaattttgattattccgacgatgagcctcacccgtggttatttccaaggttaccaacaaatggcgccatcagcgatttcccaattcgtggaacagttggctcgagttgcctacatgcttttgacagccttcattatgatgcgggtgctgcatggcagttgggtcaatgctgtttctcaatcaacttttgctgctttcattggtgcggttgccggcctggcgacccttggcgtttattacttccgccgccgcgaagattttcgacagctggttttgtccagcaataatgagatccacgttgaagcaaaacaattatatcaggaaattattgcgcaggcagtgccctttattatattgggtgccggaatcacgatttttatgctgattgaccagtttactttcttcaagattatgcggatggcaactgattacaactacgcgaccctctccgatctatatgcaatgtttgccgttaactcaaataaattgattatgattactgtgtcgctttcctctgctttggcgattaccgccgtgccgatgctctcagaagcgctgaccagcggggacaacgtcgaaattcgcaaacaaaactccaatgtgatggcattattcatgtttgtcatgattcccgctgccctgggaatggccgcaattgccggaccgcttaaccgggtcttctatggcaccactcatcaggcactcggcgctaatattctaacgttttcatccattatttccattccgatgggattgtttgtcgttatttctgccgtgatgcagggattgtctcaaaacagacgggcagttaagttctttgctgttggaacagtggttaagtttgtgcttcagtggccttgtacctattttttgggttcgtttgggccactgctttccaccgggattggcttgaccgttgccaactggttgattcttatatatttgaatcgccatttcggttttgaaaaacggatgttggacattgcttttcggaagatttcgaaatattcattgtttatgtatgctgctgcattgttgacggtttatggattgaattttgttgttcaattggttggtaatccatttggacgggttgtcagtctgatcgtgaccttggcggccgttttggttggtggggtgatttacctatacttagccttgaagagtcgaattgccgatatgattctgggcccgcgaagtgacaagttgcgacggttgcttaaaatccaataaccagctgttttcattcatatttagccaagataaaataaacaagtctccatcactgacaattcagctgatggagacttttgtgattcaatttagttatttagcttgatgcttatacataaatttcggcagagcctcactgatttggtggggcaggacgacatattgcttttcagccaatttatcagcaatggcactatgagaataaaccgccgccaacacagctttttgcggatctttgaactgggcggcaaagcccccgaccattccggccaaggtgtcacccattccgcccgttgcctgggcaggagtgccgccagtgttttcgtagacgtggttgtccgcataaacttgcgttcgatgtgatttaaccaccacaattgcgtggagctgtttggcggctgcctggtttttctctggcgtctggtcggcaatcttaatgccggatactcgctgccattccatttgatgcggcgtcaaaatattgatcgaatcctgtggcagcggcaagttgttggcagcaagcaatgtcagtgccgaaccatcaatgactaacttttgttcgctgccggcaatccgaaagacttttgtcaacagggtcaacgcactgggatcggttcccaggccaggcccaatgaccaccacgtcggcacttttaatgattggttctgcctgatcaaaattgttccaatccacaaacattgcttcgggcagccagtcatgcagactggtttgattactggggtccgtaatcgtggtgaccaagccggctccggaataaactgctgccagtgaggccatgataatcgcaccgccaaagttttggctgccgccaatcaaagcgattttgccgtaagtgcctttaaaactatctgccggtcgcttacgaatgacatctgttaaaatttgacttgtgatttttttgacatttaccatcatcagatctcccatccgaatctgtttttcaccctaattatagcatttctggagtggacaaattgccaacgccaattgaatagtgtgataaaattgaactataagaaatggacaggagcgagaaaaatgacagttgattggaaaaagcgcgcacaaagttatcaagacgagtatttgaacgatttaaaggaattgatcagtattaacagtgttcgtgacgatgagcacaagactgatgaatttccactgggcgaggggccaacccaagcgatgctcaaatttttatcatttggggagcgcgacggctttaagacgcaaaatatcgacaacattgttggctatattgagtatggttccggcgatcagacaatggcgatgcaggcccatgcggacgttatgcctgctggagacggctgggaaaccaatccatttgaaatggtggaaaaaaatggcaacgtctatggacgtggaacgtcagatgataagggacctgcgttagccgcttattatgggttgagaatgctgaaggacaatgggattatgcccaaaatgaagattcgtttgattattggaactgacgaggaaagtgactggaccgggatgaagcattatttccaagttgaaccgcaaccgacctttggtttttccccagatgctgaatttcctctgattaatggtgagaagggcaatgccacttatgtcacgacctttggccatacaaatggttccgaattcactttgaagcgatttgattccggattgcgattgaacatggttcccggatctgcggatgcgctggtcgaagtcggtgataacgaaaaatttgtcgatggctttaccgaatttttggatcaaaacccgattgccggtgatgtcaaatcaaccggtcagggcgttgctttgcacattaccggtaaagctgcccacgcgatggaacccaagaacggcgtcaatgccggcacgtatctcgccaagtttttgaatgactatccatttgacggggccgctaaggaatttatttcctacctggctgaagacctgcatgacgattcccgggcaaccaaaatcggtgctgcgcacgtcgacgacatcatgggagagttaaccatgaacgttgggattatgaaatttgacacgcagcacggcggcagcgtcaacaccaacttccgttacccgaaaggaactgatgatcaagaaattttggctcacttgcaacaggctgccgataaacgccatggaaccgttaaggaaatcaacaatatggacacccactacgttgatccaagtgatccgattgtcagtaccttgatgcacgtttaccaggaacagacgggcgatatggattccaaaccggaagtcgtcggcggcggtacttatgcccgtttgatgaaacgtggggtggcgtttggcgcattgttcccaaacgcccaagataccatgcatcaggcaaatgagtttcagccggttgccaatttaatcaaggcaatggcaatttatgggcaatcaatttatgagttgacagccaagtaaaaacattgaggtggttagtatgttggactttaattattcgaatattctggttgggattgatggttcaaaaactgccgccaaggccgttagacaggcaatcacgattgccgagcacaaccatgccaagctgacaattgtggcaattatcaacgaccgtgaaattctgggggtgtcaaaagccgccttgatcggttttggcaacgtcaatcaatcaacgatcgatgaggtcaaatccagatttcaacggctcgttcataaatacgaattgatggcaaaagaccgaggacttgctgtcagtgcctttgtaacttcaggcgatcccaaaaatcaattggctcacgagttggtggatgacgaacatgtggatgcaatcgttgtcggggccaccggggcaaattttgttgaccggatgacaatggggtcaacagcagcttttgttattgctcaagccccctgtgatgtgtttgtggtccatcgcgactagccggtttcaagtcggttagaacaactgaaatgaaaaaagaggtgagccggtatttcgagaatacctggttcacctcttttgcggtccatcattcaattttggttggctgattcttctgcggattgttaacaattaatccccagattccgggaatcacgtacaagaaactgcccaagacgcccagcacgattaaaacaatcggccacacgtatctttcattgtagtgaagtcgtttaataccaaagaacgcaatgatttgctggattccatacaccagcaaaagaaaaatggcgatcatgtgatagttccatgagttatgaacgcctgcagcatccgtcgttctggtcagcataaagattgccagcgccaaaacgacaatggtgatcacccaccagacgatccagccgcaaatttgagcggcagataatttatgttgttttgtattttgcaaatctacatctcccccaatattgtttatatcaagcctaccaagagtggcctgattcagtcaaataaaagttgcatccaggccaccaaaaaagttatacttttcgaagcacgtcattgagaaatgacaatttcgaagggtgaggtttggtcatgattgacatcgtattcagtgatagttttgcatcaacattgaagtattactatcagaaaagacatcttgacgggcaggttttggcattgccaatgtatctgagcttggggacatcagtcaacgctcgtttatggaaagccatcaaaccatttataaaatcgaatacgctcattatcaagcctctgaacaattaactgtcgaagcggtaaatgctttacggcaggggcttgatcaactgagtcaaagtgctcaggctggcgaatcgtttcgtatttggtggagtgagacggctgacgactactgcggctttttgtggatttgcgattatttaaaggatttttcagttcaaacgatgagtgtcaaggttccaatgaccttggtccgagaagacagtttaatgattatttccaaattaggtgaaatcagtgaagacgccattgatgaatttcaattggcatcactacaaagggacctgtctgctaattcccggagagccttcagttactattggcatgacttaaggagtgaaaataatccgatcagaacggtgattaacggcaccgttgtcagtcaatcgattgacttttacgatcgttttgtccttgccaatctcagtcaacggcggtttagaaatattctgcgggtaattggtgagactttgggcgattatccgttcacggctgactggtggtaccgccaccggattgattacttggtgtcaaagggaagcgtcgattataaggcggatccggacgcaatcgttgggaaaattaaattggcaaaataaaaaggggctgtttagctgtgaaattatcagctgaacatctccttttaactccgtggccttttcatcgtatctggtagacctgaaacttatgactgtctgttagagtgtctcactttgtggttggcgaattttagccaaagcatcatcaatctgtccgagaacgattgtgacattcttgggatcggacaagtcatacttctgcaagtcgattttgatcttgggactgacatcgtattcttggaaccatttcttatatgctgcccacatcttgaagtagtattcctgaaggccagggttgtcgtcaaactgttcatagtcgcgaccgcgttttttgatccggtgcttgatggtgtcaaagtcactatcagcatacaccagcaaatcaggagccttttttggcaactcgtcgagttctgccatcatgttattcaataacttgaggtaaaccgccaattcagtgtcggtgatgtttccctgagcattattttcccgggtgaacagtgcatcttcatagattgagcgatccaagacgttattatcatcactcaatgcttgtttgatcattgagaaacgcttgtttaaaaagtaaatttgaagtagaaatccgtattgttttggattggagtagtaaagcggtaaaacgggattatcgccaacgggttcaaaaaacgcttttgtcccgagatgttccgcaatttttccggttaaagtggtctttccgaccccaatcattcctgcagttattatcaccatggtagcccctctttataataaaatgacaatatatagtgtaccacaaaatgtggtaacacaatatatataatttcccgattcggaagttaaaattgggaatgccgcacatattaagtagtacaatatagttaataagttaaatggagggaatttaatgtataaagcggttgtgttctttgacttagacgggacactttttgataatgaaaaaaacgtgtccgacgaaaatgtagcggcaatcaatgaattacgtgccaataatattttaccggtgatctccactggtcgaaatatttttgaaattcagtatgtgattgatgccactgggattaactcgttagtcagcgctaatgggagttatgttcagtatgaaggcaaaaaactcaaagcagaacaaattagtgatgatgtgattgaggaaatccttgcctttgcaaaacagcagggggatgtcatttccttttacaacaataaggaatttgcgttgacttttgaaaatgacatgacgaaagtgaactatcgtctgttgcgattaacaccacatgttgacccagaattttacaagcatcatgaagttaatttcttaaacgtctttaattacgataaggataagctctaccaagacaagttcaaagggaagttgtctttggtccgtaacaacccgcgttgtttggataccatgaagtggggtgtttccaaacaaacgggaattcaggctttgatgaagaaactgaacctcggtgacgttccatcatacgcgtttggggatcaaatgaatgatttgcaaatgttttccgaagttaaatttccaattgccatgggtaatggtgtcccagaagttaaggaaaaggcgtcctttgtcactaaatcaaatattaacggtgggattgtgaacggccttaaacattatgggctgattgattaatatctcgtcaaaggttgttctcgaccatttaacgacgaaaggcaactaccccgaaacagaggtagttgcctttcgtcgttaatcatcagaattagggggtgaaacgaacccttaattcatttgcttttcaatattagccaacgtcatttctgaagtatcggcaaaattaatgtcggcatcctttaagatatttttgtcgccgatgccaatcgaggtttcgccagctgcgttaattgattcaacaccagctgccgcgtcttcaacgccgatgcactgttccggcttgagatcaatcaattcagcaccctttaaataaatttctgggtcgggcttgcctttactcaatgtttttggatcaacaatctttgggaaataatcggttaaattcagcttttgcaagactttgggcgcgtttttagatgctgaagccaatgacaataggtagccgccatttttgatttcgtccaagaatgctttaatccccggtaagatattgtcaggggtcatttgatcaaccaacttcaagtagttggtatttttttcagttgccaaatcaaccttttgctcatcagtgtatttatcttgaagatttccagctttcaaaatcatttccaatgagtccattcgactgatgccttttagaccgtcttcaagttctttggaccatggagcgccgactttatcggcaacttgatgccatgcctggctgtgaaaaaccgaggtatcggtaatcacaccatctaaatcgaacacgaagcctttaatatcggaaaattttgccattatcattcactccttattatttataggtaattgttgccatcttgttcttagtcagtgaataagcctttttcgcaacactgacgtgagtatcggcatctgcggtcacatcgatccgatgatgcccgatgacgaagtggtaattgattccttggtaagtttctttaaatgaaattttagaccaagtgcttggcaggtgaggattaatcgtgacctcgtcggtatcaaatcggacaccgccatagcatttcgtttcaatttgaagggtcgcacccattacacccaggtggattccttcggcagtcgtcccgccttgaatgtcgtagtaatctgagaacagggcagttgaaaacagctgccatgactggtccatgttgccgtcaatttcgtccagaaccgaataaacaattctggaaagagttgatccatgagtcgtccggtcaagatagaaccgtaagttgctggtaaagaagttggcgggcagcttgtaccccagacggttgatgacttcttgcacttcgtcaaacggcagttcatagtaggccatcaatgtatcagcctgtttggcaacttggtaggcgtccggtgacttgccttcgcctttgagcagtcgatctattctggaaatatcaccatacttcttccggtatgaatcgaaattcagtttggataggttgaagtaccctgagaactggccgataataccttcttcgttgatgtccaatcgcagtttatgggcgatatcgttcatcttggcgagaagtgcgtcgtcaaagccggctttttcactggcttgctttaaaacggcgctgtcttcctgcgataccagggtattgaccttgtcaaacagccaggaaaccatgatattcgtataggcattattggttaagccatgatcgttggagttagggtactcttcgtgaaattcgtcaggccccatgacatgatggatgtcataacggtcggttgattgatcgtagtcggtcatgctgacccagaacttggaaatcgacagcagcatttccaatccgtattgatccatgaattctttatcgcccgtgatgtggacataattgataatgtcataggcaactgaaatggaaacgtgccgttgtaggcggctgttatcgggatcccatttgccgctaaccggattcaagtgaacaaattgtgattgctcatcgccatacatccctgactgccaagggtacattgcaccttgtttgtcctctgaggcagcatactttcgcgcctcagctaaccggttgtaacggtaaagtaggcactgtttggcaatcgcagggtaatgaattgcatagaatggcaaatcaaacgtgacatcccaaaaaatgtgtccacggtaagcttcaccatgcagcccacgagcaccaacggatgcatccaatttaccggacgacaaagcagcactggtaactaacatgtggaaaatattgaccctggtcaacttttggctggtaagatcattatcgataataatgtcggagtgttgccaaacattgctccagaatttttcactatcgcttaacgtatcttcaaatgaggagtcatcaagttctttttgtgcatcggcttccaaatggttattttcgtcttgggaagtaaagacggtgacattctttttgaattcgtattccttgccgggctcaacgttaatgctcaaagcctgttggactttaccttcctcagtcgtggtatcgatcaattttttggtatcgaaatctggactgctgagtttggagttgatcacaaattgaacgtgtgaggtcttggtttgaccggtcatcgagacttgattgtcatgagctgacatgccgatgacatcaatgtggtgctgatcaaagtcttgataacgttccacgttgccgttaataacgttgccatcaatgccggcatagatttgtaaactgccggagaaattgatgggctttaattcatatttgattgcgtaacggtgccactgatccatgttggcaactttcgtagcccggacttggatgatatggccggttgaaagctgaacgtgcagggtggttgtcaaagtaccggtcttcagatccaagcttcggtaaatatcttgaatatcggctttcttaatggtaaatggcagttgatggtcaacaccgaaactaatgtattgggcattcggtaagttcaccaaatcctcgttcacaacgtcgcggtcattaatcttagtcgtcaattggttgtaaacaccggcaacgtacatacccgggtaattatcctgatcagcgtgggactcaacgtaggccccccggagaccaaagtaaccgttcccgattgtcagcatggcttcttggccgtagttccgtttaccggcatattcaccatagtaatccagatgccacttaaggtattcttccttatcggcaacggcttttttcagcccaacttctttgatcttttgcagattaacaaccggaatattcatcatgttggcaattgccaatccgatatcaatcttttggtgattaatgccaataatcgtatctgaaaactcatagtttaacgaattttcgataatggcggcgtcgatcggcaggccggtcagcgctgctttgatattttcaagattatcgccaattgaaaatttggggttatatgtgatcataaactttcgaaacggcggtttgttggaatcttctgaataatttaattccatgaccccatcgcgggccctaatagcaaacgttctcataacaaaacctcttctcaatttttgggaaataaattaaaccttcacacttttaattctagcccagacatcatgcaatcgcaatcaattaccgttttggaatggtctgcggtgcgtcattgacggttcattgtttattttttaacagatcccggatctcggaaagtagtacttctttgttatcgattgcaggctttgtcggctgacgcttgaggaccttgttaatgagtttgattaagataaaaacgacaaaggcaacaattagaaaattaatcagtgaattgataaaggccccgtaacgaaaagtcgcatcaccgactttgaaaatcaggtttgacaagtcaatttttcctaagaagatcccaattaacgggttgatcaaattatttgtgagggaggtgacaattccagtaaaggcgccaccaataatcaccccgacagccaggtcgatgacatttcctctggcaataaaagccttaaattctttgagcatggtttttctcctttcaactatcttatttccatgatgtatttattatatcgactttaaatacccgaagacaaactctaactttcccaattcaaacgtgaactccattggcaaagtatgatagtatgaaataagaaattttacaggagaattcatttgaaaaagtctaaattattcttaatcgtcggcgccgtcgtattagtgttagcagtggcgtttttcatcacaaagttctggcatttgtcagttctgtcgttcgcgctgatttggctgattgcaattattgtcattcgcctgattttgacgccgttggtggtgatgattgttcgccaacgcgatgaaagaaaagcccaacgagaagcagacgacaatagtcgtgacaaataagattgtttgaaggggattgtatgaacaaggattggctccacaggattttcataaccgcaggattgatcttgcttgccattggtggctttgcggcaaccagcggacaggcagctgccaagacgaccaacgtcgctgattccaaacagcaattggttgatattgtgctgcggccaaaaagtcagtcggcgcttcaccaatttgtttacaacacagtgacgccgagttcgccgacttatcgcaaatttgtttccccaagtacttttgccaaacgattcagtcagagcccaaagcagattaaagctttgcagacatatctcagacaccatcatttgagggctcagacttacaaaggtaatttgattatggtggtcaagggatcaaccaaaaacgtcgagaaggcgtttaaagttaacctggtgaacgtaaataacggtgaggtcaaatatcaaaaggccagccgaaatcctcaactacccaagaaactttccaaggtcgtttataccgtctttgggttatcaaattactcaccgttttcctcatacaaaaccaaatttcagccctcatcgctgcataccagaactgccagcgggacgacaaccaccaaaaagtattcgccgacgcgatttgtccgtcgctacaatctgcagtccctatacgataatgggtcgactggccgcagtaaaaccattgggatcatttcatttgccaacttccatcctaatgatgtgtaccgctactgggatgatgagggcatcaatgtgaaatctaatcgactaagcgtttatcggactaacggctttaagggtacctgggatggctatgatgaaacgaccatcgatgttgaacaggccggcgcaatcgcaccggacagcaacattcggacctacattgcccgtccaaacattttgggaatggtgaattcaattgctgccgcagttggtcaaaacgtggccgatagtttgtcactcagttggggccaaagtgaagcccaagtggcctatgaaatgaaacaggggattaccccgaaaaaatataatcaaatcatgaacttattatttgagcaggcagctgcccaaggaatgagtgtcttcaccgcgactggtgataatggtgcctatgatgggattaccaccgggttaacgtcaggattgtccgttgatacgccgtctaattttccatatgtgaccgcagtcggcggcacgacactgccgaaaacctatactgtcaataagaaaaaagtcaccattcaccaggaacgcacctggggggctgactttttataccccaactataaacaccaacgatttttcggaactttggacatgcttcaaagcttctttgccggaggtggcggcggttttagtaaatataatgccagacccgcctatcaaaaagggatcagtggtgtcgggacgtatgatgcgactaatctgtggaaatttaaatatggtcggccggaattgttgaaaaagccgattaatcttagcggcaaatccagcggcagaaacctgcccgacatttcagcgaatgccgaccccaataccggttacagcatgttcattacgccgaagaacaatcgaaattccaaggggcaatggctgattaccggtgggaccagtgtcgtcgccccacagatggccgcagccagtgttttaatgtctgatttcactaccaatggccgcttgggcttttggaatccacagatctatcgatttgccaaacgatcaacttcgccgttcaaaccgttggacagtcggacaaataacaccaacttgtactataccggacaaccggggaagatttataaccaggcgaccggacttggaaccgttgattttacagctttgaacaaagcttttaatagttaaggagacgctgcatggaagagcaaagaaagttaacttttggtgactactttgaacgattaatgatcttttttgggctgattattttggtcggctcagttcagctgccactgatgttcattgtccaaggcaagctgtcagcagttgccaattacgctgttggagccttgtacttgttgggctttctaatcgccatttggctggcacagtatgcctaccggaagtatggccgctacgaagtcaaaaaaatgacctggcaaaatgtcaaaacaattgtcattgcttggattgcctttttggtaattgagttcttattgggaaaccttaataaactggtctaccacgtcactcaaacggacaacaatcaggaaattcaatcattgttgtccagcaatcatcttaccctgattttgatgggatttacggcaatcttctgttcgccgattcttgaggaaaccatttttcggggatatttgatgactgcgttctttcggtcgaccgaaaaatgggcaccgattattgtcagtgggatggcttttgccctgccgcatatggatcctgatctttcccattttaatatcatcagttttttgacgtatgcgatcttgggttgtattttggcctatttgtatgtaacaactaaaaatttgaaggtatcaattggcctccattttttgaataatttaatcgcagtcggcggaatgattgcgatgatttttgccgtgtaattaattgtgagaggtgttaatcatgggattatcggttgaattgatgaatgatctttcggatggcgtcaagggtcggcgaaatctgattacagatgttggcggcgtcaaggtcgggcaggtgactattgatgatggtgacgttcatagtggtgtgaccgcaattctgccccataccggcaaccttttccggcacaaggtaccagctgcctcttgtgtgcttaacggcttcggtaaaagcgtcggcctcgtccaaattgatgaattgggaaccattgaaactccgattgtgatgacgaatacctttggcgtgggcacggccctaaatgccctcaccaaacaaatgctggctgctaatcccgaaattggggataccaccagtacagttaatccgattgttgctgagtgtaacgatggcgacgtgtccaatatccgcaaaatggcgattactgaacagaatgtgtccgatgctttggcagctgttaacgatgactttgaagaaggtgccgtcggtagtggccgggggatgatgtgctatgacctcaagggcggtattggctcttcctcgcggattgtgaccgttgataagaagcaccaatacactgttggtgcactcgtcatgaccaactatggttatttaaccgactttattgtcaatgggatgcctattggagcccccttggccaaaatgttggccaaggataagcaaaaagaagaaaaggggtccattatcacgatcctggccaccgatgcgccattgaatgcccgccaactcaaacgaatggctaagcgggcaacggttgggattaatcgttccggtggctacattggcaacggcagcggagaaatcgttttggcattttcaaccgccaatcaggtggaccatttcgaaaccagcgagtttgatactgttactcggtttaacgataaccaaattgatttattcttcagagctacggcagcggttgtcgatgagtcgatcttaagttcaatggtccatgccgaatcagtcgttgatcgaaagggacggcttcggttaaatttagttgatgcatgcaagaagttgatttctcagcaacctgattataccgatatggttgagcaggtcttttcacagcttggggtggttaaatgagtgcgaagattttattaggtgctgaaaacattcgccaacttgcttggggtgccattaacggctgtgaggcagccagcttgctggaggggctccattatcagggccgagctttagacctgaattatggccaatttctccttcagatgccaatttcaccagatagcaatccttaccacggctttggtggttcacctttcaccaatcggcccggcaagtttgaggcaatctttacccgacccctgatgtggtggggaaatcgttatggtaatctgcaagaactgagtggggcagatccccagtggttgtatgactttgtggcaaaaggggagccggtgttaacctctgtgaccgttcattttgaacaacctgagtgggattcgtatccatttggtcaggttccggctaataatcacgcggttctgttggacgggatcgatgaccaccaggtccacgtgagtgatccgattgacggtcaatactggctgccaaaaaccaaatttgagccgatttatttgtctcgtaagatggcaatcgcaattactaagtaaaattcacagcaaaatcgcatattctaacaggctttctgaactcaatattagaaaaggcctgtttttttgacacttttatgctaaattagaaccaagatgagtttgttacgcgtcttacatattagaggaggattatatcatgcatttatctcgaggagtggctgcactcgcaggtgtagcaagcattgcattaattctggcaggttgtggtcaaaagtctggtcaagctaacaagacgattaagacttcaaccgattctgaactgacgactgttgatccatcgaagaccacggctgttggaactttcaacgttttaaacaacgtcgatgaagggttggttcgtctaggcaagaatagtaaagttgaaccgggaatcgccaagtcatggacggtttcaaaggatggtaagacttacacttacaacttgcgtaaaggtgccaaatggagtaatggcgatccggtgactgccaaagacttcgtttattcatggcagcgaaccttaaatcctaagacggcttcacagtatggttacctgttctcaggaattaagaacgctgacaagattcaaaacaaaaaagccaaagtttcttcattgggaattaaagcaggtggtaattataaactgactgtgaccttggaacagcgaatcccatactttaatttgctgatgggctttcctgtcttcttcccacaagatgccaaggcagtcaataaatacggcaacgattacggcacttcggccaagactcaagtttataacggaccgtttacgctgactggctggactggaaccaataacaagtggactttgaagaagaacaccgattattgggacaagaaggctgttaagcttgatgacatcaagtttagtgtccaaccagattcttcaacgtcgttgaacctttacaaccaaggtaaacttgatatgtcgcaactgtcagctacccaggccaaacaaatgggtaacaagaaagatatgatttcacgaaagcagtcttccaactactacattgctgttaaccaaaagaacaaggtcttcaaaaacctgaaaattcgccaagcaatgtcaatgatcattaatcgaaagacattagccaacaaagtcatgggtggcggcgcaatcgataacaatagctttgtttcagagggattggccgtttcaccgaagaacggaactgactttacgaaagacacaaccgctcccgcatcaatgacttataacccaaccaaggctaaacagctctttaaggaaggccttcaagaagttggtcgttcgtcattacactttactttgttgaactctgatggcagtgaccaaaagcaattgagtgagtatctgcaaagtgccttacaaaagttacctggcttaacggttactttgaacaacattcctggtcgttcaattttatctcgacaagctgatggtcaatttactgtgaccgttgccaattggtttgccgacttctccgatccaatcacattcttgaacattttgacttccaataacccaagcaacatttccggttggaagaattcagagtatgattcgttaatcaaagccagcaacgctgacgatggcagcaatgccaacgctcgttgggatgacatggttaaggctcagaatttggccttgaaagatcaagcaatcattccactttaccaatctggtgaaaaatggatggttaattcaaaagttaagggaattgtttacaacactgctggtgccaactacaatttcaaagaggcttacgttaaataattaatgaggagtgacacttattggaacccgtgattaaaaagattgatgtccaggaagctgctgtgccactcaaacggccgttcaaaactgcattaagaactgtcaccactgcccagacgctgattgttaaaataactgccagtgatggtaaagtcggttatggcgaggcagcaccgacgccggtgattaccggagataccctcccaagcattgaaagtgccgttaacgatgtgattggcccgaaattgattggcaaaccattgtttgactcagcggatattaaggcgactatcgatcagtcaatggtccataattcgagtccgaaggctgctttgaatattgccgttaacgatttactggctcaatcgtatggggtgccactatatcaactgttgggtggccactcggatcacatcacgaccgattatactgtcagtgtcgggacgattgaggatatgatcacccaagctcaagacttgattaccaaaggatttaccactttgaaaatcaaggtgggggatgattctgaagaagccgacctcgataaaattgtggccatcagaaaagcagttgggccagccattcaaattcgtttggatgccaaccagggctggcatccaaaacaggctgtggccgttattaatcggatgcgggaactgaatctgaacgttcaactggttgaacagccggttaaagccactgactttgatggtctggcttacgtgaccgccaacaccacgacgatgattatggctgatgagagcatcttttcaattgaagatgccgctcgcatcattagtatgcgtggttgtgatattatcaaccttaagttgatgaaggcgggcgggattgataatgcggttaaaatcaatacccttgccgaggctgccggaattccctgcatggtgggtagtatgattgaatcgtcggtttccgttactgctgcggctcacttggccgctgccaaacgaaatattcagtatgtagatttggacgcatcgatgatgttctccagcaacccaattgccggtgggatcatcaatcaaaaaaacgaaatctcttttccagatttaccgggattaggatttaagtaacccaagaggctcggacataaggattcctcatgttccggccttttttgagtagggtgaacaagccagcaatgctttttatgctatctggcaggtagttggtggctaatgaggtataatatatgtatactaaaatttaacgaatggaggtgcccagatggaaacaagacgagtcaaagttccagtggcaactatttggaagtctaaagaatcaccaagaaaagttgatcaaccagccttagacggcgatggtaaaaaatgggttgaacaaatgagtgatgagcaatcagttgcgctttccgatgatgacttattagaaacgcaggctttgtttaacgatgaagtcattattgatcatttcgacggtgactgggccaaagtctatattcccagtcaacgagatgattctgattcaaggggctatcctggttgggtgccaagtaaattattaagcgatcagcagattagttatccaccggttacctcaattgtgagaattgctgttcggacagccaatttgtatgatgaaaacaaaaagccggtcctcgaaatcagcttgggaactgtgctgctacaaacaggcaccagtggtgactacattgccgtcgtgaccccgcttggaaagggtttcattgacaaatcagcagcagtactgccattcgttggtagcaatgctggtgaaacgatggttgagatgggacgccaatttttaggcgagcgttatctctggggcggaaccagttcctatggttttgactgctctggatttgcgtacacgcttcatcgggtacttggatttgatattccccgggacgctgacgatcaacaagaaaacggtttacctttagcaccggaagaaatcctaccgggtgacttggtatttttcgcgtatgatcacggcaagggctacgtgcatcacgttggcatgtacattggtaatggaaagatgattgaatcaagaacgccaggcgccaaagtcgatattgcagaactgactgaaccaaaatttgcggccgagttcgccggctttaggagatattggcgatgagtgagctttctgaaacaattgaacgggtgatggctgacagttcgtttaagtatggcttgttaattcaaagcaacggtcagaccttggtggaccatgatagccacgaggccttcccatcggcttctttgatcaaattggccatcttaaacgatgttttggacagcaacgttgatctggatcaatccgttgatgtttcgacggatgagttggtaggcggtgccggaatcttacaattgatgtctgttcggccatggaagcttcgggacttgttggcgttgatgattagtgtgtccgataattcggctactaatgtggtgatctccttgatgggaatgaatcatattcagcattatcttcaaacccatgatttccacgagaccgggctggaacgttatctgatggacggtcgggcacttgccagtggcaaaaataactataccagtgctgctgaaagtttgcggctgcttcagcaagcacttcataatggttccgaagtccagagctggttcgccaatcagcagttccgatacaaactaccaggtaattttgatgaatcaggcgagaatgttgctgtatacaataagactggtgagggcaatttgattgaccatgatgtcgctcaaattgtatataacaaccattctgttgacattgccatgttgactgctggatccttgaaccgaatggaaacgatccaaaaatttaatcaagttggccagtcagtggttgattggttggcatgaacaaaaagtgagcgtgaaccaataagtggtttggctctataaggggattacccgaattccagttggatatttcgataatcccccttatacggtcggaagctgcttattggcccacaattatactaggtaacattcaaacacaaatcgaggctgggacaaaatctttcattttgtcccagcctcgattttaaattggatttatgattagattatactctgcaccaaaatcttaacattttggtcagagcgtttagatctgtgtttgattgtacaaatcaagcttttgttcaatggtcgccatcgtctgagaacaagtttctttttcagctggggttaatcccaaaacatcaaagcagctgttcacacgactgaagacattgtcctgttgctctttggctttatcggttaactggatgacaacggttcgctcgtctgcttcgcaacgggagcgggtgatccagccatgattttccagccgcttgagtaatggggttaacgtgccgctgtccaggtggaggtattcgcccaattgcttcactgagagcggtgcatattgccacagagtcagcatcgcaatatactgtgggtaagttaaatcaaaaggcttcagtgcctgctgataaaaatgattaaattttttgttcgctgagtagacttggaaacacaattggctgtccaagcgaattggttgggtttgaggcataatttcaactcctattatttttgcacatactgccgtgaaacacggacagcactagtcgaatcaatttaaatactttatgttattattgtaatgtatttatatttaaaagcaagacttaacacagggagtcaatttaattgcggacaattaatttgacataaaaggggattgttacatatgaaaattggtaaacttagatttagtacttggttattttggattacggtggtctcaatggctgcttatattggttactatggttattggttaatgaaaggacaaccaaaatttcacgggcagacgttgctcttggtggaggtctttattgggatcctcattgccagcttgccatttttaatcgagaagttgggccggttttattttccacagattgaattggttttcttctatattttcctatacatgtccattttccttggatccggattgcaattttacagtgtaccgttttgggataagtatgaacacgttttttccgcaatgatgttggctggactggggttttcaatttttcaaggattgatgagtgccagagataatgcaacccacaaaccatttttgatgagtctgtttgcctttacgtttggaacgacttgtggtgttttctgggaaatgtatgagtttaccgctgatggactgggtggtttgaacctgcaacggtacgaagaagctggcaagttgttgctcggccgagcagccttgatggacacgatgactgacctgatcgccgatttggcgggggctttcctcatggctttgattggttacctgatgatgaaacatgatccaagttccagtcgatatctggttttcaaaacaaaacgacaaaacttcttttcaagttactacttttagtgtaaaataaaacatgttgttgccctcgtggcggaactggcagacgcgcagcgttcaggtcgctgtttgagcaatcaagtacaggttcgaatcctgccgagggcataaccacgtaaaatcaacgtttccgcacattcgttgatatgaagcttctgattcctttaaataaggaattgggagctttttttgttaccaaaaagttgccgttattttctgttaatttctctgtttttcagaagttgggcaacaaaatggcaacatcgatggcaacaagtttgtgaaattatttgttgtcgagctgatccagcagctcaactgtcttatcttcttcttcggtttgtttatctttgaaaagatgagcataggttgtccgagtgacaaccgtattttcgtggcctaatcgtcgggcaacatattggtcggtgacacccttagagattaagaagctggcatgggtgtgccggaggccatggaatgtaattcgcttgctgatgatgtggcggaaatagatgttttttaaagccttgttgacgtcggttgatgaaactacatgtaaatatctggagtaaaaaacaaagtcgttgggattgcgataatggtgacgatctagaaagtcgttgacaatttgttgccattttttaagaattgttgccaactgatcgtttatcttgatgacccgatttgactgttcatttttcgtcgggccaaactgattatcgacgtagtaccaaaccttgtcgattttgagcgtcatttttttgaagttgacacagtcccaggttaagccgatgacttcctcgtagcgcatgccagtgagcagggaagtggcgatcatggcgttcgtcacattcgtaatgtcgttgatgttgtccgttgtgtagttcagcagcttctgcatatcgtccatatccaaatacttttctgcctgcgttttacccggcagaccagacagctccgcatcttgggtgaaatcagccttaatcttgcccatttgataagccttgcggatggcagctctaaactgactatgtactttctggacggaagcaatactgtgatccttagcaagtgtgttgataaatttctggtagtcatcatagtcaattgaagtaagtgctcggttgccaaaatattgatgaatgaccgtcttggttgccatgtagcgtctgattgttgctggggcaatgtgggactttttgaaagtgtcaaaccaaccctggaagtagtcggtgacggtctggtcgcttaatttactagatccatgtttctggatttgagcttcttgcgccgttgcccatgcccgagcaccagatttagtgctaaaacctgtcttactgagccgcttacgtcgtccattctcttggtaggataacattgctgcccacgtcttatctcgcttgtaaatggaagccatggcctctcatctcctttcgcacatatgttcgttatgtgagttaaacaaaagcccccgaaagggccaaggttatttatttttttaaattgttgatgatttcagcattttgtttttgcaaagtatcattctgcttgatcatcagccaattttgttccacgatagtttgcagattattgataatcatgttttcggcatcggatccatgtatacgagcacctaaactataagcaagcacgtctattaatccattttggctcataatgtttttaacaagctgataagattttggatttaagtcatccaagtcgtgttgtgctaaaaaacgcttaactttttgctctcttttttgctctcttttttgttctttttcttcttttgatttaaatagccccattttaagatctcctcaataatcattgtaataaacttgttgcgaatacatatttacctaatatcctaaaatcttggtcagttttcttaggaaagatgagcggtttataaataggattaaatgactctggttcaaggataactgctttggaggtttccttgaacctctttagtgtagcattttctccatctactagaacagcacatatgtcgccattttcaacctcacagtcttttgcaaaaacggcaataaacccgggagcgataaccttactcatggaatctccatcgacctgcagcgcaaacaaattgtcacggccatacttatctatcaaatcgtccggaataattgtttgaccgataatgtgctcatcagcaaaagtcgggagaccagctgtaatttcaccatagacatctaatggttcattagatgttttccacttaggagttgctgaaattgttgcaccatcgcttgttggctcaacagttagtttgtccactgaaggggtgtatccagccaaattcattagatcactttgcggaacttttaagcccatagctaatttttccaacgtttttggtttggggtttgaatctgattttttattaatcaatttggacaaataagcaggggaaacgcctattttcatggcagcttggcgaatggtccaaccatttttatcaattgtttgctttacatattttccaagatttgtgtcattaattgaaggcattaaatcatcctttcatttgtctaaaacaatcatataacagccgttaagaaaagaataatattattttaaaaaagtgttgcatgtttctaaacgatgatgtattattaaaagtgtcaagagaggagatgaagaaatgatcggaatgtccaaactcaaaattcaaaacacacatcaagcaaaacatcttattgcaatgtctggacttacatctaaaagatttgctgagatggttaacataacaccagaacatatgtcttcagtaattactggaaaggccagtccaagcccgacactagcaaatgacattgttactgttattaacagtcgtctaaaagtggaataccaaatcaaggatctttttttagatgtaagtgttaagaaacatgcaacaccacccgtaccacagagaaaggaggtgagggaatgattcatcattatatgactgaatatcgtaatggaaaaaatgaagttgtctttgtgtcctggattcagctcaactttttaggcttagtgtggtgttactccgtaaaaagcttcattttgaacccggataaagacaactccgatgcgattgataagttcttgagcactatgtcgtatcacgaacgctaatctgttaatggaataaaccaattatcccactaaacaggtgatgtggacgtgaaactcgcgaggcaagcacctaaggaggtgaaagaatgaagcgtgatgcatatttgcttatttcaaaaggggtatcccagcttaaccaagatgaatgggatatgaccagaaatatcgttaacagattgtttaaagaaagaacttccaagctacagcttgaaagttccgaaattcaaaaaaatttaaaagaatactttgaaagccaagctaaagcagacactgacttatttgctcaaaatttcagatcccataagggttaatctagaccgactatccattagaagagctatttgttttagcagaccaaaactcttctaaaagcctatcgtcattaagacctcgtaaaaatttttcgaccatttcacgttgttccctaagatattgaaccaattcaccgtcatttttgagatttttattggcgttgtgagctgagtcaaccaaaaaatatcctgcaaggacactgataagaaaatttctatctacatctgaaagagatgccataaagatcaccacctttaatagttagcagattttgagttttaggaggcaattaaatgcggaatccggataaatcaatggttcgaaaagtaaaggtcgtcaagttaattgaagttgtatcagtgattggcgcgggtacagaaagaagcatgactaggtatctcaacgaatattacacattggatggcagactattagccagtcatgacacgctccaggatacagaaaaagagcattaatttttcttatcttgtcttcgatcttgtaagtgggaatcaatttgattgatatcttccataagagtctcagcatcatgacgatttatataccaattcttaataagaagttcgattaacttcaacaacttttcagcttcgccatcagaaatctcaaggattaagttaacatctttttccatatgagctccaatgtttccgatctttctaacagaatgtagaacattccggatagcaggagaaattttatcagaaatatcatcaatttctttaaatagggaactgtcggtgactttgaaaaagtctctaatcattccttgtagacatcttcttgataaagttgcagaagcttttggactgaggtgaagaatggcatatgcctcttcatagtcgtctcgtatttgcagaggaacataatcaggaaactgaattgccttagattttggataaacataagtcgttacatccttgtactgagatcctagcccgtatgtctgtacagagattttcccacacgctggacatttatgcattatcaactttagcaggtcttttggataagaattacgtccaggaataaatccatagtttgctattgatctgtcactaaaagagacagacgcttctgcttcagtggtgggcgtgatagcaacgatttcattgcaaaaagggcatctaaagtttttgttttctgttgtcatttttccacctcgttgtatggcggaaaatcgaagaaatcatgataagaaatatcgagcgctttacacaatttgcggatagtccccactctaggatttttactttcaccgttaacaattccatttaatgttgtttgaggaacgtcagataaagtagcgagtctattaactgtgaggtttctctcattgaggaaagtgaaaagtcgttctgatataagttgtgcgtcggttttcattgcttagctcctaactattacgaatatctctagtataagagatatttttacaagaaattaccgaaataccgttgacagttatctttatggcggtataataaagttacctaaataaaggtaggtgataaaaatgattggtgacaaccttaaaagattgaggagattgaagaattactcgcaaattgatctatctaagctttccggtgtatctcaaacaacaattagcgatgttgaaaacaacttgtatacaccgaatatcaaaaaaatcgtcgcgctcgctaaaacattaaacgttgatgtcaatgaattactgacagatgaggataaggaggtgaccaagtagtggaagcaataaaaaacatttagttttcaaagaacgaaaggatgataccaatgaatgaactaattaaaactttcaaacaaaatgatggttccgttgctgtcgacggtcgggacttgcatgacttcctcgaagttgaaacaccatatcgaatttggattcaacgaatgatcgaatatggatttactgaaaatgttgattttgcaggttttgaacaaaaaagtacgaaacctcaaggcggtcgcccacaggtaaatcatgctttaactttggatatggcaaaagaattatccatgattcaaagaacggacagaggcaagcaagctcgacaatatttcattgctatggagaagagagccaaggcaaaacaacaattaccacaaacacccgaagaaaagattatgttactacttcaaaacgccaatgaagacaataagaagatcaatcaaattgacaaccgagttaaggatttggaacataataagcctttaactcctggagagtataactacatttctcatgctgtcggtggggctgttaatacctatgttcaaacacatcacttaatcttgactactaagcaacgcggcaagctttacaaagatatcaacggtggcattaaacagattgcgggaatccaaacacgagctcagcttcgcgaaaaggattttgagaacgttgataggtatatccgtaactgggtaccgtcaactgcaaccatcctgattatcaagcaattaagcgaaccagtagctagtaatgaaggctaacttctatccttgattgtattgtactttgacaagttggaaattaattatcggctatttaccgattggagatgatgggtatgtataaagaagcagtgcaactagatttagctttaaaaagttccaaatttaaatcaccgctaactaagttggcacatgaaattcctgccagcaaagcttcaattagtcgttggcgtcaaggattacgcaagatggataacgatacgttaaaacgaactgccaagtttgttgatgattggttctacaaatattcggcggctcgggctaattacgatatcttatcgttttttaaaagcaaacgagtgcgtaatggtttgtttgcagcgctgaccaatcaagaaaagcaggaagatgatcgtaaagagatccaagcaattgcttttcaaagcgcttctgtacctctcaacgagcgtactactcaagactggaagaacattgatgcctttagtaaagaatttcccgaagagattagtgcagaaattaccgaattcctggaatggtgtcaatacaatgacattgatcctaaggaaccaatcaaagaattcaatcagaagttaggaggctaggatatgagtgagccaagcattaccaatacggaactacttaccaaaatgcaagtaatcgagcgatattttccgggatgtggatataacaccgttaatccagttttctacgagaatgactttccaaagttgattattcctggtaagaaacggccattgtatccagcaccagaagttgagaaatggatccataatcacacggtctacggattctaagaggaggttatgtatgatgattacttttacattgagtggcattgctttctattcaattttcttagtgattgcgacgattttgttcggcaatcccaagaagtattttgacggcgtgttatcgaaaaaagatatcaaggatagcgttaaaaagtattttgatcaagttaaagcagacatcaacgaaataaggagaggatgattgaaatggaaaattcagacaacaaaaaaagcgctccgcaactgccattgcaaaacgcttcaaatacacgattaggtgcaaatcaaattcatttatacgtctattctaacccccgtaagggaatatggcaacgtgtgaaggaggcaattaaccatgaatgaggatgagtattacgaaaacatggctgatgaatacgaagatccaaagccaacacaagaggagttggccgaggcggaatatgccgaatatgaagaccagtatgaagacgagatggatattggaggagtggaaatatgaacaagaagctggaatatgggttgagaaaaattaaatatgcgcgcttacgagtcactggattggaacgagcttatgaccaagaaagcaacccgatcgttaaagaagcgttgctgacttgtctcagaaaagaaaaagataaactaaatgattacgaagttaccggaatctacgaggaggattagctatggatgaaattaaagaggcaccggaaaaacaaacatttgttattgatgacgataataaagcaaactgggcatttcgtaaattagctgaggttaagcaagagctggatatcaaagcgcaacaaaaagccggctttgacgaacaaaccaaggaatggtacgaaagcgaaactgaaccattgaaagaaagccaggattacttggaacaattgattgaacagtatcgtcaaacgcaacctgatggcaaggttaaagttccggctggttataccagtctgcgtcatgctaaacaataccaacgtgaacccagtaagcttcttccgtttgtagaaaagaattatccagacttactcaaaaaagacattaaatgggcagacttcaaaaaacaactgaccgattatgacggggtagccattgatcaaaatggcgagaaagtacctggaattactgtgatcgaaaaggaatcagttagttatcaccctaataaggtaggcgatcaactatgaagatttacaagaatggagaaattccacgaattcccaatatgtatttcgtttacggcgatggtggaaccggtaaaacaactttgctgaaacagtttgaaggtcataaattactttttagctttgatctgtcaagcaatgtcttgattggcgacgaggatacggacgtggtgatcttcgataaagctgacatgcccaagattcaagctaaagttgttcaggttatcaattgggcaattcaccagcaagtttatcgagtgattgcccttgacaatatgtcagccttacaaaattacgtactcgagaatattgataacgcagctaaagataatcggcagaattatcagaagctacaactatggtttcgggatctgggtaccatgcttaaatcaagcggtgccacgatctatgctactgctcatcaggttgacaatggaacgtcaggattaactggaggcggtcgttatgccgctgacatgaatgagaagacgtttaacgcgtttaccagcatgtttgatgtagtcggccgaatctatgttaaagatggtcagcggatgattgatttagatccagagcaggggaaccatgccaagaaccggttggatgatcgtaagttaattcatgcaagcgaactcattcaatccaaagtaactaaattaaagccaaacgaaaagaaggagcaaacagaaaatgccattgttcataactgattcaaataatgttttaggtgcaagcgtccaagaagccggtttatataatgtgaaaattgtcaaagcagaagtaggaaagaccggacgtggtcagcaaaaaattactttagactatgaaattattgacggtaaataccaaggtgcaaccattccataccaaactttgacctggaatgatgaagatgcaaattctttgaaaaagtctcagcgtcgattcaataccttagtagttgctttgggagcaactaatggaacaccaattgattcactacaaagcattgtcaattcagctgttggtaaaacattatctattgatacggaatggggccaacccaataacaaaggaaacatctatttaaacgcttataactatcatccagttaatccagatggtagtcagccaaatggtgttaagcgtcctatcacaggaaaaactagtgacaagccagctactggtgcgccattgccaaatgataacgacgatccatttgcgaacagcaatgattccgttgatgttaaggattcagatttgccgttctaaattaaagattagtggtgggtgggaggaataaaggagtgttagcatgagtcaagattctatcgaatcacttgtaagtccctttgatcttgataattataggcaattgcctaattcattaaaacaagttatccgcaacaatgtcgaattacaacttgattttcttttagaggacattgatcgagttgaaagtcctattgaaaagatatttcttatttatttgaatgatcatgaaactagtccattttgggaaaacagtgaaggagcatctttagttgccacagcacagtttcctgtgattattggtaagcattcctatcgggtagatttttcaatcagctatcatgacacaattagttcacttacttctacggtatttgttgaacttgatggccatgatttccatgagaaaactcaagagcaggcagcaaatgacaagaaacgtgaacgccttctgatgaataaatgtgatgggttattgaggttcactggctcggaagtctatcacaatccccagaaatgcgttgaatcagcgttgagtttagcccgagaaaaatatcatcaaaaaatggttttaaaaaatagctaacttgaagggggggagtagtagtgaacaacggttggataaagttatatcgaaaattaattgatgatcatctttggactgaaacaacccccaaacaaaaaacggtcatgattacgattttacttatggcaaacagtcagactaaagattggaatagaattggaacttcatatcacgttgacccaggcgagcttgtaacatcactaaaaagtattgcggaaaaagctggaattggtattagcccagataacgtcaaaacttctcttaaaatgctgaaagattctggatttcttacatggaaaagttcaaacaaaaatcgtctcataaccattgctaactggggaaaatatcagggttcacaaaatcaaaattccaagcaagaatcccaaaagattactgatactttcccgataggttcccaatactttccaactaacaagaagttaagaagtaaagaagttaagaataaagaattaaaccataatgtcgagaagcagagctcagaccaactcaaaggacaagtccatgaggttatcgcttatcttaattcccaaacttctaaacacttcaaagcaaattcgaaagacacagtgaaattaattagtgcccgtttgcgtgataactacatcgttgatgactttaaaaaagtgattgatattaaaacttctcaatgggcaggaacagactatgataagttcttaaggccgtcaactctgtttgcaccaaatcattttgaatcatacttgaatgaacggcctataaaacaaaaagagcttagccggcatgacgatacctctagagattttggcggatccactagatatcgacacgaggctaagcccgaaccaattcgcacaccccagaagggagacgagccattttgaaccaactcgactcaatgatgaaaagctttgccgacaagctcttcgaaacctatggcactcggtgccccaactgcggggaactgttactgcgtcccaaagttttgaataaagcgactggcaaaaagatgcatggggcctgctttaactgcggttataaagagcccctgccgacacataccacgccgactaatgaaaaattatcggaacaagcccgaaaggatgctaccttgaagtactttaacgcgtatagcatctacagttcttttgaggtctttaatcaccgctttgacaattataccgcaagtacttcggcacaaaaactagttaagcagcgttgtcagaaattagccaatcagattgctgaagagcaaacgattcatacgatgctgctaggcaatactggtgttggtaaaacccatttagcagtggccatgatgtaccgtatctttgaactgactcattatcgtcaaaatgggatgtttgttgactggcgccaattaattgctgataaaaaagccggtatctcccaaccggatctgcaacgaaaagttgataacagtctgcaccatctgcaaactgcagattttgtcattattgacgatctggggagcgaacggactactgatttttcactggatttggttgaccaactctggcgctaccgggagaatttatcaacaattgtgacttcgaatctgattgggagtgccttccaagaaaagtatggcaatcgggcctttagccgcatggccaatcatggcgtgggcaacaccatcttgtttagtgatattgaggatcaccgaatgggggcgaaagcatgactaagattgcttgggccgacgaaatgctcaaactagctaagagtgaagtccatgccgattggattcttgaacgctataaggatcaaatgcggatggtcgttcgccaaggcggtaatcagtacgattcgaattgtcgagaaatctttcgacgctttgccgtgatggtgacgttatatcaatacgacgccggctttttagccaattttgaatggcatccggatttagaagctgaggattacttgaattttaaagcggcaatcgcccagcagaaaaagaaggctactaacacatgagagttatcgctcaacgacatggtaaagacctggtggtacatctcagccaagaacccgatgaagaccatttagagacggtcaacggccaatcagatcaagtttgggtggatctaacgtttgccgatccgcgccaagcccgaccacagcaacggcggttattctttgccctgctaaatgatattgctgagtattttgtagttccccaggaattcctaaagactctgttttatacccagtatgagttttataccgctggtaagtccatcagcctatcagacgccactcaatcgtcagttagcgatgctaaccagttactcgacctagtgattgactttatgtttgaatggcacgtgccgtttaagaagggctatgagctattgcctaaggatgaagcctattaccagtatgagtgttgccgtcaccgagtttgtgccatctgtggccgtgagcacgctgacattcatcattgggacgcagtgggtagtgagacacgtaagttggctgatcatcggcaacatcggtttatggctttgtgtcgcgaacatcataccgagtttcacacaattggcgcagaagcgtttagccaaaaatttcacgttagaccgaccagattaaagctagcggacctcattaaactgggagttatgacccagaatcgaataaacgaaattgacaggaggaaaaacaatgagttttcaagcaattggcattaatagtcacaaagaatacgcaatggcacagtacaaagctgaacttatgaagaagctggcgttgatttatccgacttatcggaacagttggagaattgatggtactcggacgaagcaagcgaatacgccgatctatccggaaccactagaaataattaagaggtgatcggagaatgaaattcctagatttgttctctggaattggtggcttccgtttgggaatggagcaagccggtcatggaggtatagttatggcaaaattaggacgcaacgaattatatacaatagctggagttaatcagcatgcggaatttgaaaaatttataagcgatttgctgttcaaaccaaaagaacgcaatgatttttataaaaaaattctagctattaatagtaacgtatcaacagatacgtttcgtgaatactttgaagaatatgccgccgagagaaaatctcaacagcaagattttacgcctaattctgtttctgaattactagcaaaaattactaggaatgataatagtagtaaaagtggatggtctggatatgatccaactgctggaacaggaacactaattattaaaaaatggaatgatgacagattagcagaaacgccattcagctatgccccacacaactatttgtatatggtggaggaatttggagataacgttattccatatttactacacaatattgcaattaggggtatgaattgtgttgtgattcatggtgatacattagaaagaaatataaaacagatttattttgttcaaaattcgcatgatgattacatgaaattctctgatataaacgttatgcctcacaccgataaagttaaagaaaaatttaacgtatctagttggagtgaaaaagctattgaacatgtcgagagtgataaggttgcatacattccggcacttccaatgcaccgtaaacacattattacattaggagatgtcgacgatgattaagtttaaggattcggattgttatccaataaaatttgacctgtttagactgattgcaatatctgacaagttaacttttccgatggtttggcatgaaaaatattacttgaagaaagttattcagattgacaaagacagcatattcatacttgggcgaaacttagaattggaggggcacgaatgattaaatttagagcgtggcatatgccgtttgggcctaaagggccaatgcaagaaatggtacatggaaaagctagtagtattttggcgcttgctgagatgtcaccagatgagtatatcgttgagcagtacaccggaatcaaagacgtaaatggcaaagagatatgcgaaggcgacatcgttgaagcaactatcgaaggctgtatacagtatgacaaatatctagtaaaaaatatgtgggatccacatgtgtggacggaagaatcagatggttattatgctgtttcaaaaatggaagtaaaaggcaacgtacatgagaacccagaactactggaggcacagcatgacacacaatcagattgagtgtcgcaattacgtggctagagaggttgagcttatgagtaaattaattgaactaaaaattcgtaactacgaaaaaatcattcacgatcataaccgggccaataagcgcttctatgatgaattattggtcctgatccaacaatgtgagggacgttataaatcagtcgctgaagctcccgatgattcgcctgaatggcaagcaatcgttcttaagcggactgaacggccagttttaagtttccgatcccgcaaaattggggatatgtcagcacgtgaagctgccaagattcgtcgggaagtcgtcgagctctataatcgcggctatccaacagcaaccattgctcatattttgggaattagattgtctacggcaggtagcacaattgcaagttatcaacgtcaaatcaactcccaaaatgctaggaaggtgaagatgtgatcatagcaatcaagggcgatgaatatcagaagattcaagtagcacatcccaaatggttgccaaagtttgataaagatgatccgcattttgagattgtggaaggtggactagatggctaaaaatatttcaacagcatttaagttcaatgaacgggatgccaaaatctcagagcacttactgatgtatgaagatcaaccgaaccctgaagctattcactacttcaccaagcattgtgatgaattaaccaactatggttactggttcctgctatcaactttatgggtctgggcaggagatgtgaatgccgatctaaacttttggcgcaaattattttcaagcaatcgaccggataaagagattagtttgatgaaaccagacgagttaaaagagctaaaaagcttaccaaataagttgacggtttatcgagcgccagcgtctaacgaaactgatggaatctcatacaccacagatctagcaacagtcattggatttgcaaagcggaataaatcgaagtttattttcactggccatattaagaagcatgatataaccgcgcttttcttgcggcgtgatgaaagtgagcttttgattctggatcagaatctcattcatggattgaaaaagctttcaataacttcagtaaatttggaggtagagtgatgaaattggcggcgaatgaggatgatatgcaggaattacgcagacgcatattgtttatgttacgtgatgatgataacggtaacgggcagtattcagtagggttaaaagcggcattatgggaacttgaacatattgataagccttttgtacatgggaaatgaaaggggaatctcaatgttactgcaagaaactaagaagtatgtaaataagttatctttgtttatctgtccatatgtaattgtatgtggcccgaattgtttacttgatgctttttaaaaagagagatagctaaatgaacgtttcaggatttggaggaaaaataaaaagctcccgtttccggaagccgaggtgatgttagtattctgacgaattcattataacatcaactaaggtgacaacaaaggagttgcggagatggatagtgtctttggcttattggatagaaaacaaacaataaaaaatgctaaacaatttttatatgagtatcgggattggcaacttgaagcggctagattcagtttctccctgcagtcgccgatgatggacggtatgccaaaggcacagtcagatccaagacatacccggcaggaagataaaatgattaaacaagccaccgctaagatggaatgtgaactacgtttgaagactattcaactcatgagctccattgatgatcaaaacgccttcttagccgacttgttggaataccggttcattaatcactatacggtcaaaaagtgctgtgaacgcttagcggagaagtatgatttaggttatctggctgagcgtacatataacgattaccagaaacaagccttatgggtttttgcgatagtttgtcctcgtgatacactgcgagcaaaaaaagttcgccgataatctgccgactttctgccgacaatctgccgatgttctgccgaaaaaatgcaaaaacaggggttatattggtattgtggaatttgttaaaagagtttcactttctttccttagatgtgtggctgtaacgtatacgtacgaagagggcggaaagattaccgtgcagggttcgattccctgccagccacgttgttgattggacttgtatcaaagtaaattcttcctaaaaattaatgattagtacccgtccaatcaacgaacatgcagctcacgaaaaaacaaaaacttgtatgttatgttgtctagaacttgaactgtagtgagctacatgatgcccgcggcggaaaacgtgggcttttttagtataaaaaagctgcaggtatttaagtcgcctgcagttgggactttatctctcccccaattactattatgccagaagcgggaacgcttacaactggtactgtgaaggaggtggcaatgtggccacgttaattattttaatcctggtcatgttgttgccgcctgggatcgctgaatatggccgttataggggctggtggtactgatgagtgattgtagacatccatatacgcccatgaagcaaaccgattacggttatgtttccaatgaagaaataaagatagataaacaactcgataaggatttaaagaagcgtcttcgcaaagagggcgcttttaatttgcacaaaaaaacagtcaagcctgattagacgacctgcttaaaagtgatgaattgtttatctgattttgactttaaatcattaatatcattttagaaagttatttcaccctattggcttaattcctacttagaagcatttaacgctttgataatcttctcgttttgtgcaattattagccaattttgttcaaccaatgctcttagaaaagatgtagtttcaagggtggaacgatcaacaaaataattcttactattatttgtccttaaaacattttttcgatctagttctcctaaaatagattcaactgcttcagctgtttctggactaacgtttcctaatccactttcattaagcaaacgatgaatttcatcattatttaatattgtcattgcagatacctccttaaaaaatggcacacaaacaaaccacaacatttgctttattatctcacaacaaagtattttttggaaatatagcagtttaaaaatagaaattattgaggtgattcatttatgagcaagcacaataaacatacgaagagtcacaagaagtcaaaaattaaggatcgcaagcgtaagagtttagtggctcgacgattgaatgagctaaaactcagaaataaaaccgatagcattgcttaacggcggtgttttttaatacatagaataactaaatggaggtgtggtgatatgtaatgaataaggagaaaattagagatttagcaactttttatgaattgccattaaagcaacgcaaagcgatcatgctaatgtttccgggcaatctcacacaagagaaaatcattgctgatctccaagtagccagttcgacattttacaattggaaaactcatgaacaattccgcaaagcccagcaagaatataaccattacatgttgattgatctgacaccagaagccattgtcacgatgcgcaagctactaaacgccaagtctgaaatggtaaggtttaacgccgctaaagatattcttgatcgttcgatgactgtatcaaccttagaggatgcacagcagcgtaaagttaacgccgatgctgcaatggccgaagctaaactagctgatatgcaggacaataaagatgatcagatggatgcattaactgatatgttgggaaaacttgctaagaacgttccgaaggatgatcagaatgacgattgataatctatttactaagaagcaacaacaggttttaaaccaagaactgaataatcgtcattggaaattgatgattaattacggtgccgttcgtgctggtaaaacatttgttgataattttgtttttctatatgaagttaaacatgctgctgaaattgcacgatctaagaaagttaaatatccaatgtacattttggccggagtttcaagcaaatcaattgccaataacatcttgaatgaaattgctaatacatttggattgacctttaaatttgataaacacaattcgttcaagattaaatttcctggcttaccggcagtcaaaatagtgcagacgtttacaggttctatatctggattgggtgctattcgtggaatgacttcgtttggagcctacattaatgaagcctcacttgccaataaagaagtattcgaagagatccgttcacgatgctctacaccaggtgcacgagttgtttgtgatactaaccctgatgtgcccacacattggctcaaaacggattatatagataatcctaagcattctagcgaaatcatcagcaatcactttacaatggatgataacacctcattggatccagaatatgtggctggtcaaaaatcaacaactccatctggtatgttctatgatcgtaagatactcggattatgggttgctggtgaaggattagtttatcaagactttgacaaatcaaagaatctaattactcgcgccgagtttgacaaacgaactgctaatcaacagttaacgtactattgtggcgtcgattggggctacgagcacgatacgtcaattgttgtattggctgatgataatgatggtaatacttacttagttgaagagcatactggtcatttggagcagattatgcactgggtcaagattgccaagcaggttcaacaagattatggctacaatataccgttttattgtgatacggcccgagttgaacatattgacaagttcgaggaaaataacatcaacgctcagtatgcgtataaatccgttttaaagggcattgaacaagttgcggggcttattaagcagcataagtttatggctgttcaagaaggaatacagcagttcttagatgaggtttatcagtatgtttggaatgacaaaacgggtgaaccagtcaaagagcatgatcacgtaatggatgctattcgttacgccattgccacacgtcaatggaatcatgaatatagtcagccacacgataattatgatcagcaagatcaactgctcgctgacaaaggattgatcgattatcccgatgatttattttaggagtgatgaaaatgtcaaagctcatgacaatggaagaatggaaaaagcaagcaactaccaaggacacagcaccgcttgatatgaatgtgtttgaaccgatgcttaatgggaaaccacttgaatttgaagatcgaggcatcacctattcggtaccaattgggctggatgtcaaaatgatatttgaaagtttagcaaaattagtgaatgacaacattaatgaaacagataaatcggtcaatgactctaaaaagttgttggccgttaaatttgctcataaatattgtgaattacacaaaaacgatgaaagtaaggtaaatgacagtggcggaaacaaatgatttatcagcacattatcgctcaattaatccacagccaaattccattaacttattaaatggtcgacgttatggtaatcgatatgcatttcaaaccaatcagtcatacaacattccagtatcctcatggcaaccaattaaagatgatccaaataaatttcaaaagttagtgcaatggtacgtcagcgatcactttaataatcaactgccccgaatcttggagttagaacgttattacttagccgataataatattcattactggttgtctaataagcgttctaatcgggctgataatcgtatatccagcgctttagcacgatacattaccaatattcaagttggttatgagtttggaacgccattgacttttggctatcaaaataaagatgatgaaaacgacactggcgaaaatgttattcaggctgtaaatgattttaatcaaaccaatgatgaaccatatcacgaaaaaattatgggaaaaaatctagcaaatgttgggcgagcttatgaattactgtatgtacctgaaggaactaagcaacctaagattacggcaattgatcctaacagtgcatttgttgtttggtcaacagatgttgaaccaattgaattgttcgcagttcgctattatgccgtgaacgttgctgatagaacatattatcaaattgaggtttataccgataaccatatctatcactttactgctggtgccaatcctgattctgattggaaatcaactagtgatgaggaacactatttccaacaagttccattaactgaatatcgattgaatgaggaacgcgtgggcgcttgggagactaaacttgatgaaattgacgcctatgaccaggctctatctgaaatggcgaactcacaagcagattttagcaacgcgatgttgatgattaatgggaaagtttctaatcagtctggtaagactgaacaaatgctagatcccaaaggccagccagtatatctcgataacgtgagtggcggctatacaaaccagtcaacgacaaacggcaagcctaacgcaccggttatggttcagaaggttttagatactaaggccaatgtgctttatctaaagccatacgtgcatgataatcctaatggttcgccaactatcagtaatacttcagcagcctatttaaccaagtcattgaatgctagtgagtggcagatttatattcagcagttgttatctgatattcataaagacaccaacacaccagatacaacagatcagaactttgcagccaacgcctctggtgttgctatggcttataagctgtgggggtctgatcaggaaatggcaatgtcagaaacgctttatcagcggggattgcgaagacggctacgactattggcaatttattggaactatgtttcaagcacaggtatcaaagtgacggatgacagtaatccagccgacaatgtaaccattacgtttacgccaaacctgcctaagaacaaccaggaaaccatgacgttaattcaaggcctgaatcaaactggcaagttctctgcacaaacattacgtgaattagccgaaccaattactgggattcctgctggtcaagaaaaagagcgatctgacgatgaaggatctcaacaggatgatcggaccgctacactgattgccaatgcacaagctaaggcacaaaagatgaacaacggatcgggtgatgatgatgacaacgatcaagcaggaacgcaagaagatcaacaagatgatcaaacgggacaaccgcaacaatcagacaattgatggcttctatcagcaggctttaagtatcgttggtaatcatctccaagagttttataacgaatatgctgatgataatggtttaacccttaatcaagtgtctcaacaggttaattcctgggatattcagagcttttaccaagcaattgatgaaatgctagctaacgctagtcctagtgataaattgtctaaacgcttgcaagcaatctttgcccaagcatctatttctcggcgtgatatgttgggtgcaatgattggtgccggtatgagcattgctacagcaaaaagtgaatcatttgcagttaatgaactcaaacagcagtatatcgatggctataataattcaagccctaataaaatatcaacagttccagataaagtagccaaccaagctgagtattctcaacgaatttgggtgcatggcgacgtcatgacgacacgaatgaaagaaaccctgaacaagggattgagtcgcggcatgcagaaatcagacatcaacaaaatgacccgcagtattcctcaaagcggtgatcgaattaatgacaatttagcaacgccaatgaatcagatgctgtccagaattcatacgttaacaactaatgaagctatacgtaatagcaacagtggtaagaacagagcgtatgatgaacagaatgttcagtatgttatgtggctaaccgaggaagatggccgtgtttgtgatatttgtgaaccacttgataaacaaacatttgactatggacaagcaccgattccggtcgcggatactcatccaaattgtcgttgccagctggtagcctgtgatgaagatgggaatctgctgtccggtgaacttgatagggtgcttgaggaacatgaaacttaaaaactaattatttgatttgcctttttctcgattgcaggcgttaaagaacaatcgatctagttattgcacttacaaacaattcagtctacggacttaaaaaaggagttttgatgatgaaaactaatttgcaattctttgctgattctaaccaagaatctaagccaaacgattccagccaaaatcctgatggtaaaaattcagagacagatggcaagacatccacacagtcagagacatctggcaagacctacacacaggatgatattgggaaaatgatggctgccaaacctaaggaagttgaaagtaatctgaaggatgattttgaaaaggagcttaagcaaaaggaacaagaatggcttgaaaagggtgaaaaacgagccggcatgaatgctagtgagaaggcccaagccgatttagaagagcaacgacaagctctaaaggagcaacaagatcgccttcaagagaagttagatgaagcgaaccgtaaggatgccttagcagcaaccaaaaccgttctaactgacaagcacattccagctgaatttgcggagtttattagtgatgttaaagaagatgttcgtaacaataacttggatcagtttacaaacttgtttaataaagcagttcaggaagctgtcgaaaagaaagttacgggtaatcaatcaccacagaatggcggtcaacaatttaatgcttctatgacccgcgaagattttgcgcagatgagccttgaagagcagactaacctttatcgtcagaacccagatttgtacaacaaacttaaataggaggtgtaggtaatgaccgtaattaacggaaatcctaccaattttagtaatttaattgaaccaacagtctttcttgactggatctatcgtcaaaatactcaaactaatcgatttgttcaatctggtgtcttgaaaaatgacccagtattaggtggccgattgcttcaaccgggacgaacggttgagattcctgcaatgaatgatttaaatggtgacgctgatgaatggaacgatacgcatgacattcaaactaatggtgttgacactgctatggaatacggcattaaagcctatcagagcaagtcattcggtaatactgactggggagacttgatttctggtgcaagcacccagcaacagattgccaatcgttttggtaactggtggactcgccaagatacaaagattcttttagatactgttaaagccactttcaacaacgcagatattgcaactgcaaagtctttcggtgttggcgctgaaaaggaattatctgccgcagactttgttaaggcactcgcacgtatgggcgatgtgatggataacaccttatcgacattagttgttaactcagcagcttattcagaaatgcgcgaacaaaacctaattgaatatctacaaccttctggcgcagctactccaatcgccacgtaccaaggcatgggaattgttcaagatgatagtattccggttgcttctgatggaactacttatgcactcatcttcggtcccggagctattgattatgcaaatgccactccggctaatggcctagttgttcaacgtgacgaatttcaaaagggcggcatggttgccatcattcaaaaacgggtagttacttgccacgttgccggaacaaacgttgacctaactcaaactaatcccaacacttatttagctgatttggcagcgggaactaaaccgttattccaggtatcctatgacccacgtaacattcaattagttaaatatggttttaaagttggaactgattatgttgtcccaactatcaattcacctaaatctaaggcctcaggtacgtcaggaagcggatctggttcatcaaccagcggttctggctcatcaaccagcggttctggaactggtaaataggaggtaatcagcgatggctgaaacacccacaattgttgatgtgaaaagcgattataaaatttttcaaagcttcagtgatgaccatattactgaaagaattaatgatgcaatcgcaaaagctgagcatgatcaaattagtgatgacgcgttagcaaggggaattatctcctggacgcgtcatttattatatacagactggtttatgaactatggtggtgttcagtctgctggtacttttggcaatacccaaactatggttaacttcaatggcgttgatccctatttacaagaatataaccaaatagttgatgattatggtgtttcagatgaaatgggagccgtgtggacagaatgacagaggactttaatcatttaaccagtggtattgaacagctggaaaagttgcagagcgtcagattatccattggggtgccctggactaacggccgtttaaacatgatcgctttggttaatgaatatggggcggacgacagcatagcagatgcttatccgagtattaagcctaaaaataaagcatatctagtcattccaactaaagaagccaaagggcgtaagcccggagagattgctaatctttttcgtcccaggccaccacataatcatgttttggctgtcccagataaatcgcaaccttatggaatgcgagtaatgttcatattaaaggatgaggtgcatattccaccgcgtccttttttgcgttacacgtttgaccactatcttgataattggactgaattagctgctgatttggcatttaaagtattcattcgagaaataaattatcaggacgtttttcctgttttgggtgatgctattgtcaaagatattaagcgaaccataaaagaattcagtgaaccaaaaaatgcaccattaacaattgcgaacaaaggatttgatgatccattgattgaaaagggtgagttacgcgactccattcattggattacagaaaggatttgattttatgagtaaagaattagttgttgtagaagctgttaaagacaataacggagcttatgtaaaaccggaacgcaaaactgaaacaccagataatattgcatttttgcctaatgcttctgagccctatgtagttcatattactggctatgatcctggcgatagtattcccgacggaaaatattatgctgctttttatgatccagatactcaaaaattcttaggacaatttatcgccgtgccgggttttaccgttgccggtgaatcaacccctgaaaatgtcacagtggtaccaacaaaagttggtggtgacgtaggcttgggtgataatagcaccgcgcaaaccccagatgcttctgccagtaccggtaagtaatcatggcgtttcagaactttaacaactttgcttttatgaatgatcagttagctgaagacttaacgattaccgttattgggaaagatactggtgaaacagatgatcttgggaaaccaattatggggccgaatgtggtctatcacgtttccgaagtaataactaatacaaccaaccctaacatgacctacagccaggaagacggtggccaattgccggttggtaccttatattggttatctcatatggtagcttgtcctaaaggaacgatagtccaacgatctaatggggcgaagtatgaagtagttaatcatgcagacgatttatccgctggaatgacttactaccagataaaagaggttggtactgatgagtaacaatttttatcatgctttctcagcggccttagttgccgagattaagcaatacttcccggatgttcccatacgtccacaaagtattaataatgaggcgccaacttatccgtatatcgtttataaaatttacgatgactatgatcgggtattgtttaacgatgcggaaaatgagacgtttgacttgcatattcaatttaaggctatttcaaatgatgaaatggaagctaaatcattaggacatcagttacgaaaattgttttttctacagcagcctgaatacgatttgcttcaaaaaagcattgtggctaaacgctgtgatgctattccaccagttgatcaatatttagatgttgattggcaattcacggcgggagctgattatacgtttgaagttcaagacaactttactgatcaaacacaaacgggaagtattgccagtgtaaatccagaatttaatataaaaaaaggagctgaatcatagtgtcagatattgttaaacaaactacggatgtacatttcattgttgctatccacgctttaaccaattcggatagtactccattggtagcgattgctaccaaaaataccgatgctactactaagagtaatatttatgatgacttgtacagcttatcagcagattatgctgaaaacacgggcgtctacgatcaagcagcggcgatgttcgaggttaatggttttaatgggcctgttgaagttatttcatatcctaatgtggattccaatacaccttcaggggttaaatctcaaggaacaactactggtggtacggttacggctgcggctaccacaacgccgggaattgttgctgggattacccagcatctatttgatggttttaaatatttagtacttgacggagcaaccgagactgagatcgaggcgctttctgattttctatatgataaccaaagaattatgttggtaactcaaccgaactcggttaccgcactgcaaacgttagcaactcatgttgccggtgttcaaacagtaaagaaccagttaggtaacactgctgcaattgttgaaacagctacggatcgctatcctgctgctcaggcggtagcgtacgccgcagctaacttaccagttgatttccagcatattggtaacctttcacagtttgaaccagatgctaatttaacaaccgatgattatgatacaattgctggtttaaatgccacgttggtcgtgaataaggctggcgattatatgttgttaaatggtaaagcgttagctggtaattatattgatcaatttgttcatactcagttagtgattgacacattgcaaactaacttgcagaaatatcttaaccgtaagaatttcccaatttacaatgatgcaacaatcaaagagatgacacagactatcaacgctgtcagcacaagtctattacaaatgggtgtgctgtacacggcgattgtcgttaacagcgttcctcgagccaacgtgttaaacagtgacgttactgcccgtaaatataatgggtttagtttaagcgctcaaattgctgacgacattgatacaattaatgccaaacttgatttgactttgtaaagggagggaaatactaatggcaattacattatccaatggtaaagaggttaacctatattcggctcgtttccttcacatttatttgttatggaagaatcaatctaaagagcttggcggttttcaaaatggtgaagcgttcagttcacagagaacgagtgctgatactactatgcaaggcgattttcattcgaatgttatgttttttgatacagaagatgaaactggaacgattaccttaaacacctatccaggaacatctacgacagatattctgttctatatgtatcatgctcaacacgatttaatggaagaaggtccattaactgctgatgatttgttcgggttgaatattgttaattcatcaactggtgaaaaaattaccgcagaaggctgccgactcgccggcttgccagctaaccagggtaatgaagcagcatattcattggcttggtcggtattagttggtcactatcaaaacgatggtaaccagccagaagattcaatgttttcttaaattaaaatggaacaggaggactaccgctgcggtggccctctacataaggagtaaattaaaatggaaaatagtgaaaaaaagcttgaagccttaatgggcaatgagattcataaaacggttgaatggacagacgataaggataaaaaacacacaacaaagatcactttgcaagacccaggtattggagtggctacccaagtcatggatttaatgaatgtcggcgacgacacgtctgattacggtaaagcatttgagctattgatgcagaacgtcctagttagtccacatttgaattacggcaccttgaatcatgatttaccagaaaaactaaataagaaaacgattgttaagcaaaacagtgctggtgatgaagtcaaaattaatatggtctttccgggttaccgaacggcattgcaaatctttatgatgactaaccgcccttctggagcgctcaatatgcacgatactttggattctcttgataaggaagttctgcgtactgatgaaagcactccacaaatcgtcaagatgaggtattggaatgttggtggacatggttctgggttaggtgccacagctttaagcgaagcacaagcatatcttgggacgttgttagcacgaaacggcctgctaaatattttgatggaatcgtttcgctttcttgcaacaacgttacgaccaaagtaattccaaatatgctaatgaatttggcaaaatcgatgatcggttggcagaaaaagaaatcaataaagattttatggttatgtcagttgaattaggagttagtgaagatcagattaacttgatgactcaagatgagtatatttttaatcgagccaaagctaaattggttcgacaagaaaaggaatcggttattgcccaaggcgtgtattacggcatggctaaaattgtaaatgaaatgtttggtaagaaaggaggtaaatagtaatggctgaagcaaaagaagttcgtcacgctggcattggacttgatctcagtattaatggactagacgatttcaaacgggctaacagcatgatggatgacttcctggagacaatgaaagaagcctctcgaattactgataaattcaaaaacaattttagtggctttggtggtaagagtagtgacgaggtcagaaagactcgtgatgcagtccaagacgtttatcacagtatggattctgcaaagaatgaaacaaatcaggtcactgaaaatgttcataaaatgcagcaagaatttaagtatacgagtgatgccgccaaaaaaatcaagctgaattcaggactgaataatgaagccaaaaaagatgctgatacaattcataaagtccaagatgagctgcgtgatttaccaactaaaaaggttacggaaattaaaactaattttgataactcaaacaaatctaccagcaatggttcaaaactaatcaaagattatagtgatcatgttgataaagcgcatgatcgtgtaaaacgactacacgatattattttcggtagttttgttgggacggcagtttctaatggtattcagaatttggcttcaggtatttggagctctgctaagaatggcttcgaactagccgaagcaggcgaacgtattgcaagtcagtggaaaacaattggcataaccagcaaacaaacagaggaattaggcgatcaaataggtgatattcgttctaaagccgatatgtcggggggcgcaatagattcaatgcagaagaaactttatgcgctaacgaatagtgtcccggtcaccaaaactttaactaatgaaatggctgcttatggttctgaagcaggtaagactggcgatcaaatagtccagatgactaacatggtggccaaatctttgggagcaaagacagttagtgctggattctttaaccgagtatttggccaaatgccggcattacgtaagcaaatacaacaagctagtggcatgaccaacgctgcttttaataccgctcttaaaaacagtaaaatcaccggtactgaaatgcaaagctggatgatgaaggctgctaagggtagtggatcggcatggaaagcatttagtaaaacaaccgctggacagatagctgccattaaaggtgaatggcaaaatttggaagtggcttttgctaagcctttatctgctggatttgccaagggcatggattcaatgactggtagaaatggtggtttaaagtccgcccgtaaagaactagaaaatattgttaaactattaggaacaaaggttggcagttttgctggtaaagcggttgcttttattggccaacatcatggtgacctgaataagattgttacttctcttttctcaattgttaaaagccttgcgattggaatatggaaaccgatagctgccgttattaaatcaatgagcggaaatagcggcaaagcttccaagggtttaaaaggtattgctgatggattaaagaatatttctaaacagaaatctcttattaaaggggtggggacagcgttactaggattatttgtggcaaaaaaaattctagatacggtattggccttaaaagattttagaaattggattttaaaagtaactggtgctgaaaagctcatggatatagttgctgatgccaacccctttgttttgcttggcctagcagtggctgccgttggtgtaactttgtatgaattatataagcacaacaagaagtttcgtaaattcgtcaacggtttaatttcatggtcaaaaaaagcttgggaaggcgtaactaaatggtttggaaagctagccaatggcgttcgtaaatatattaattacttggtcaaagatgttaataaacgttgaggttggctattcaaggatatggccaaaataattaaggacgcttggcgtactatcaagagccttattcaagtaattgttgacgtgtttactggtaaatggggtcgacttggtaaagatattggtaagctaacccaaaacctttggaatgatgttaaagatctatttaggactggctttgattgggttaataaactaaccggcggcagactaggaaaaatggctaaattctttagcaatgcttggaaagatatcggcaagggatggaaagacttctggaatggtattgatgattggtttagtaatctttggaaagggattgttaagcacgttcagaatggtatcaacgacatcataaaagttctaaatgatggcattggtttaattgatggagttatccacatgtttggcggttcaagtaaagcaatcggtaagattggctatgttcactttgctaatggtacaggtgtgtttgggaatcaacgtcatgagattactaaaccaactttagcaatgctaaatgacggtcatgattcacctgaaactggtaatcgtgaaatgctgattcatcctaatggtatgagtgaactgattagaggaactaatgttaagcggttgcttgaaccaggcgctgaaattttgaacgcttctgaaacaaagtttgccttatcgctgaatgggatgagccactttgctaagggaactggtttgctaagcaatctatggaatggtgctaagagcattggctcatcggttgttggcggtgttgaaaaaggattcggagcaattggtaacttcgctggtggcgttgttaaggccactaagaaagtatttgataccgttaagtcaattgttaaagatccaagtcaatatttaactggactgcttaaaaagccatctggcaagggaactgttttatcagactttgccaatggcttttttggtaagatgaaattctcggctactaattggtggaagtctctttgggggatggttaatctggatggaggcagtggtggtgatgctaccggactactggccgccgttgaaaagtatggtcgtggtaaaagatatgtttggggtgctgcgggtcctaacacatttgattgttctggacttgttatgtatgctctaaaacacgcctttggcattgattatccccacttttctggtgctcaatacggtaaaacaaagcacattagtcgttcaaacgctaaaccaggtgacttagttttctggggccctggtaaacacgttggagtctttgctggtggaaataaatattggtcagcgttcgcgcctaatggtcatccagacattggtatgcattcaatttctggttcagtaccaggatatagcccgttatttggtgaggttaaaggactagcaagaaagactgtttcaaaaggtaaaaaatcagcttctaatagcattcaatcgctcattaagaaacaagttggcagcggattcttcaagtttatgtctaagttagctaacaagtttggcgataatggtgatatgggatctgttggtcttgctggagatgaaagtcaacgagctagagaaatagcgaaagcccttaaacaagcttatccctctgctactgatgccggaattgccggtatcctaggtaactggatgcaagaatcacgcttaagcccctcggcaattgatagcgctgatcatggtactgggttaggtcaatggacatttggacgtgaaaccggattgcgtaactgggagagaaagcatggttatgcttggaactctgccaaaggtcagctggaatacgcacttcatgaacctggcgaatctggatcctttaaagcagtattaaggatgaataatccagccgacgcggctagaaagttcttcgctggttgggagtcaggcggtaatgaagacgcaaccggaggaactcgtattagcaacgccgaagccgcatataaagcgattaaaggatatgccaaaggcggccgaattcaaaagaatcaactggctaaagttcatgaagacggctgggaattgtttaagcctgatacgggtggtctaatgattccgcacgaagcttctgaaaagattattaacggccaaaataaaaaagtgtcaattgatgctcgaactaatttgactattcaaggccatgctgatagttcaacaatcaataaaattgatgaacggatcgaaaagcgtaataacgatcttgttgagaaaatgcgtcagttactgggctcaaatgatgaaggaggccttacggtatgaccaaaaaatcagcaaaacattctgttaaaggtaagactttaacttatttgcagaagaaatcaaccgaatggaaatcaactgtcagcaaagatgctgaccaaattgataaggctaaaagcaccattgataaggccaaagataaattagacacttacgatgaatatttgcaaaagcaaaatgggtacagcagtcttaaagatgcctataatgctaaacaagatgaaattgataagcagaagaaattattgagcaaaaccaagaaatcttctaagaaaaaatcaattgaatcaaccattaaagacctaactaaacagaaaaaagaagtctatcaatcaattactaagcttaccaatactgctgaatatcaaaagcagttaaaagctcgcacaaaagccaatcatgcaattagtgttgaaaagaaaaaaattgatgatattaacgtaaaaaagtcaaaggataaaaaaatttatcaaacttatcacgatgcttatactgctaagaaaagggcggaaactaagaagaaacaaactcaaaatcgatctaaaattaacgataaaattgcggctgccaagaaaaaatataagatacacaagaatgtgtatcttaatgggttaacaacgattcagcggacagatgcaatgactagtcgagtttttatcttaggtgaatcagatccatctgaaactaacgatcaggatgttccgactaacgaagtagataactcagatcctcgaactaattacagcgttcgaagttccaaacagttatcaggaacttattatttatttggcaaaacaagtgacttagatacacaatttgaaatcttacaaggctgggctcgaaagggagttgaggttactgttcgtggattttctaaatgggcgcacgcctatctatcctctgtcggtaaaacagccaacacagcaggaaacaagaactcgctggcactatcactaacttttacgtatgctatgaagtcaaaaattgattatgccaaaaagaaatcaaagaaaaaaactaagtcgtcaagcactaaaaaaagtggcaccaagaaaaccactcataaaacgacaaccgttaaaacagggatgacctattggtcgatttcacaaaaaacgggagtaaaagtttctgagttggaaaagttaaataagtggccagctaattcgatcccagttggggcgaaagtgaggtatgaataatgccagtacatgactatattccaatatcacctgctgacattccttatcagcaagagattgatctagactcaggaagctatttatttggattccagtggaatgaaattgatcagtcacttacggtagatatttatcaactcgatggtacaccaatcaggcttggtgaaatagcagctttaaaccaaccgttatggcacggtataaacgatccaggacttccaactgaaacgattattccaatggatgagtcagggaatgaagatgagattgatcttggaaacttaggtgataccgtgcagttatgtattgatgatattccggatggtgaaaaatgatggtagaaaaaactacaaacaagggttactattggggatattcaactactttggttattaaccataatggtaacaagctaacactctcagaaaaaaataatgtaccgattaattatgatatcccttctgatgatggtggcagtcccgctacctgtacggtaaccctgtttaatttatcaaaaactcatttggccaagattaatcaaaatgatcacattattgtttacagcgggcctactgatctatacggtaaattaactgagggcacgatcacgcaaattgctccggagacccccagtggtatggataaggaaacccagataacctttgaagaaggacgcgattattcaaaggataagcgcctttacagtaattttaatggttcgaaaatggtaactcacaccgttaaagccagtaatggaaaatcaatttcatataaaaaacgaaagatcagcaaagttaacattacgttcaaaaagggcatcaaagcgagccagattattgaccggattaaacgcgaagctaaaattgaaatttcagcaattaatttaaagaaaaatcatgttttcaaaaaaggatatacgctatcagccaagcccttagcagcaattcaagcaattgtaaaggattgtgggagcacggtttattatcgtaagggcgccttatatatcgatgatggtgttaagcctaatccttacaatgaacatctatatctcacgatgtaccatggattgacacaagagccaacctatagcagtgatgatgacggtaaaccgacatggactttagaatgctttgatgatccacgtgtttgcgcagggtcagcagtttatgtgaagtcgaccaatcttactggtcttcaaagagtaaaaagtgttgatcatactcatgaccaggattcttataaaatggaagtggtagtttatgcctaagaaaagaaaagttgcaattgatgctaaaaataagcaatccaattttttgaaaaatgaatttttggaattttttaaatcagaagttaattgtcacacaatcggacgggtgatttcatatgataaggctcatcatcgttgtgatgttcaaccactaccacttcaatcagatggtgataaacgagcggctttaactgaagttgttgttcctgcatcagtttggcaaatggacaccttctttaaaaaaaattgtaccaataaaaatgttaatctcaatggttataaaccaatggcaattagctcggttgtctgggttggcttttgtgatcgggaaatggataattggtctggcaaagacaactataaactcgatactaaaagaatgcattcgatacaagatgcggtgattgaggcggtgattgagccatgattgcatttggattagacagcactggtgatttggattttaacccaaacactggtgcttttaatatggtcgaaaatgatgatgaaattgctcagaaactcagtttactattaaacattaatgttgctgaattgctttggaatgaagatattggtcttgatcataacgaattacttgctaatgcagatgaccaagggattattcagtcaattctatctgactatctgcaagaacaatggcccgatacttttgattcagttgaaattactaatttcgaagctaatcaacaacagcggattacttcactagaagcaacggttacccttacaactggtgaaactgtcacgagcagtgttagcgtcgatgatcaaggagatgaagatgatgccactaacagctaatggatatgatcgccctgaactagatgatctacgagacaatatcaatgctttgtttgttaaatattttggcgatggcattgatctagatgatgagcagacgccaggaatgattgctggcattttatcagaagttgatgacacgttggaaagtttggcccagggggtttataactccttttttgttttgaaaagttccggagcaaatctggatgatttggcagctgaaattagtgtttaccgtaaaccggcaactaatgcttatgtgtatttacaaattgatggttatgtagatccagattcgccaactgttattccagaagggacacaattttctaccccagatggtcaactattttcaaccttggcagacattacgattactcaacaagcaacatatgttgatagtggtggaaatacacaaccattgattgataatgatggtaatcccttgggccggcagacagttcaggcggtagctatggataccggaacggactcaaatgttatgccagcaactattgttaatccagttaattcaattgacggtttctatgcagttactaaccagcaagcagctacaggtggcatggatgcagaaactgatgatgcgctacggcaacgaattttagataaccgtaaaagtgctgagaatagtacgcctaatggcattcaaactgccattaaaaatctaactggagtaactgatgttcgtttggtcaataataatacaatgaatacagatagccatggaaatcctcctaaatcagttcacctttacgtaattggcggtgatgatagccaaatttctcagaaattctttgatgttttaccgccgcaaactaaaactattggctccgtaattggtatggcaacagacgtaggtggtcgtcaatataccgtttcgtttgatcgggctgagacggtaccaatttatgttgaattggatttgaatgttaaaagtacggttttcgatactgataatggaccacaaatcattaagactaatatcttaaattattttgatactctcaatatgggtgataaagttctttattcaaaactatttggacccggatattcacctgctggtgtgactgatgttgctgttaaattaggtacaaatcctaaaacattgacagaaacggatattagtatcagtgattttcaattggcggttatcagttctgacaatgttacgattaacgtgattgaaaactaaagaggggtgctaaatgtatcaaaccgaaaggaatttatctgataatactttacgaaactggttagtttcaatgtttccggcgattatgaatcaggaagatgaatcaaataatcaaaacttattaaacttgatcgctgatcttcttaatgggcacaaaaatgacttgctcagtatatcagatcaggctttgttaaataatgcaagtgggcaaacattaacagatattgccctggactatggcatcaatcggctagatgatgacgatgattttttacgatttcaagttcgtttacaattattgaaaaaccatatgggcattacaactaatgatttaaaaatgttgattgcaacggttttaaatattggcacagatgtgttcgacattaacggtaccgataatccagaagaagtcgaagtgaccaatattccctttgattttaattcaggtgacaaggcagaagttaaacgtaaaattttaaccaatgctattcagtcaatgctgccaccagaatatttactaaaggatttacagtatgcaacgacagttaacaatcaattttatgtaggagttcatgcccagtcttatccacaaattactgttaaggagatggtttaattggcaacgccaaacgtaggaatcttaacgaattcaggtaaaaatttaattgatcaagttaatgctggtcaaactaaaattacttttagcaaaattgttttttccagtatgaataataatcaactaactgatgaccagataaaagcattaactacagttgcaccacaagaaattgtagttaataatccaaaagttactctggataataacactggtgaaactcgaattagagcaactggtaataatgaagcattaactgatggcgtttatgttaaaacttatgctgtttatgctaaagatgattcaggcaatgagatattatatggaattacggtatcccctaatcctaattacttaccagaatatgatggtgtaaccccgcaagctgttacttattcatacaaagtgaatattagcaataccagtaatataacttttactaattcaaatgacatttatgtttcagatactgatttagctgaggcattacagccttatgccaagacggttgacgttaatcagcaactggataaaaaagtgaatattgctgatatgcgtaaaccagctagtgatgtagcgggaattgaagaagttaacgctaaacaagataaaattggttacacgcctgctgatgatagcaaagtgttgcattcaactgtaactcaattaaattcaactgatatgaatactgttttaactgctggattttatcagttaattagtggaactaatgggatgcctaatgcggatgcgtggacaatttatcaagtaattgctttgattggttcaaatggggttcaacttgcatacggaacgaataatactattttaggaatgcgttcttggaatagttggagtaattttactagttgggttcaatttgctgatgattcccaagtagcccacctatctggtgctaacaactttgacaccgttccaactgttgacgataagccgttgcttctcgcaagcagtttgccgtctgatctagcacgaacaggacaggctcaaacattcacacaaccgcaaacattcagtattgcgcccactattaaggacgcctcgacagataagggggataatcaggccgctactatggccgatttgaaaagcgttgaaaaaagtgcttggcatcaattagacggatcacatatcacgattgattctgctacagattattacaacacggattgtttgtataggattgatcctgtcaacaagaaaatatacattcactggataatggtatttagttacaatcgtaattccgacacaaatggacatttagatttttcaagtgtagtttcaagatttacaagtcaaggtactggcggcatgatgtatgaaagagggtataatgctggtagtactagttctgtgtttaacattagtggaagcaaaatttcatttttagtttcaagcggtccatctgtttttgcttctggtcccctagaagattgctggtttggatacgacacgttactaatatagacgattaagtatcgccccttcggtggactaatcatcaatgtataaattattatgttaaacatctactttcaggtaggtgcttttattttgcctaaaaattaggaagtgataaaaatgctaaaaaggattggaaaatattattcgcatttatgtttcggcttagcttccttaatggctggcacgtatgtcttttttcatttgaattatttggacagcccagaagttacaccgccacctcctggctttgcggaacatgtggttttcggtgctgccgatgattggtggtttgccggattactggtggttggcgggattgtcctgctaagtggggtgcttcttaattcaattactttaagaaatgccggcatgattattattgccccattatttggttatctcgccttcggattcatgatcaggggcgtttttgatattcgctttaatttaacttgggtgtttgccagccttgccgttgcattgctgatttgcactgcaatgcgaggtggaaaacacaatggatgttaaacaggttgtttcagatatgatcagcttaggcggcctaggcggtctagccacgttaattggaaccatctgggcaatcattcatgaacataaaaaagatgcgcgtcaagacgatgaagaccgtcgtaagttagacgactggctgattcaaaaagtgaaggagacctcggacgatgctatgaaaaatatgcaaaataagtatcaagatttgaaagctgatttggatcaattatcaaaggaaaaagaccaaatgcaaaaacaattaggccaacaaatcgcattgaaagaggaagaaaatcgcagcttacgtgaatccaatcggcgattgaaagaaaccaatcgggcacttaaacaggaaaatgatgagtatcgcagtaaattcggaatgttaaataaaggagatctctgatatgttaaagaaaaactattcaactttggctttattgtttgcatcaaatgttttagacggtggtaaggatatcgagaaagttcccactcaactcaaaaatgaagttaaggaacttatcaagtctttggaagcagacaccgaaacagatttgttaaaagctgatggtaaagtcatcaaagacgttgctaacgatttggaaaaaaatgatacctaggaggtggccaaataatgttcgcaattttaactaaaatttttaactatttacaatcaactggcgttttggctgcaggaattgcttttattctagctgtttggaaagcggttttgccacttgctcaagcacacgctaagaccgcccaagagaaatcgcttttaaccgcaattgaaggactggttgcccgatatgcccaggtagcagcgttgagtaagcaagaccgttttgatgccgtgcttaatgacacgttagattttgcaagcgatcacggttacacatgggctaagtcagacttgattaaaggactcattgaaagcatttaccaagcatacaagagtgcaggtaaagatgttgcccctgtcattacaactcctagttctgacgttgttaaagatgagcctgaatccgatgctcaaccaacaaccgataacacgaatgccacagcagatacttcgaaatcagatagcaccgatactgtagaaagtgacggtgcgagcgacatttcaaaattggaaggcgaggttgagaaataatggcatattcaattatcgttgacacgtcatcttttcaatctgattctcttgcgttttttaacactttgaaatcttacggtgtttctggagcaattgttaagttaacggaaggatcctattacacttcacctaaagccgctaaccaaattgctaatgcttataaagcgtttggtgtggtagctgcctatcatttttggcatggtgcttcaaatgaggctgcctatttcctagataaagtaaagaagatgggattagataaaaccacttggctggcaattgatgtagaggctgccgacttgccaagcaattgtacttctggtattaataggttccttagctacctatattccaatggttatcacaatttacttgtctatggatcagcttcatggttcaactatggccgtattcatagagcgcaacttgtatcatatgctaaactttgggtggcgtcctatggaacttccaaaccgggtgtaaataacactgctatttggcagttcactgataacttcaaaggcttgcatgtagatgctagttatgattttaaaaatttattgaaatcaaatggtaaatcagacaccccaattaaaccgtcatattacgcttccaaaggattgtttgaggtaaaagctgatatggtgcatgcgtataaaaagttgccccttaaaggtgataaaaacaagcgctatgtacgttttgctaagggcagtcgcttctatggagttgcagttaaagacggtgacatctactcccttaaaacgcaaattggctatgtaacggccaacaaggattatgtagacttaatcaaagaaattaaataaagtatgttaagaagcccacctcgttaattcggggtgggctttttgtatttaaagagataaacattgacactctgattttagaagagtataaataagtcatagatatcaatcccctcgctccacatttaatgtggctggtacgccagtatgcgaggctttttttgtgaggtgaaatttagtgggagttcagcctttgacgactcatcagcaattggagagacttattgaactgggaataaaatccagtccaagaaacattcaaaaagatgaagaagctctagaaaccattggatattacaaattaaaggaatttgctatgcccttcaatattaattccaataggcaagatggagaaaatttgaattttaatggtgtttccatgaaacaattggtttcccgatattttcaagataaaaatctaagagttaatgttttacattcaatcgaatctattgaagttacacttcaaaaccaagtcgcatatttgcttggaagaaaatataaagcctttgggtatctaaatttcgcaaattggtgtaatcgtgagaaattcaaacgattcgatgttgagaaagaacaggtatattttaaacagaagctcttaaaaaaagtcaaaaagtcacagctgcctgatatgcagtatgggcacaatttaaacgacgatggctttccaactgtttggctgatgatcgatgctttaacatttggcgatacggtcaatcttttaaaatatatgtcaaagcctaatttaaaagctattagtgaatcttttgattgtactccttctgaattgctctcatggctggaatgtttaaatttggttagaaatgtttgttgccataattctgatcttttggatatcaagtttaaaaccaagccaatggttccggccaactatgcagaaaatttatatcgtgtaaaaacaggacattataccgacaagatagcaattgcaatttttataatccaacaacttatgttatcagtaaattcaaattatgattttggtgcgatcgaacaagccttatacaacattatcggtcaaagtgatgaggcagcacatactttaggatttgcggatggcaaatctatcttggcattgcatgttagtcccagtcgccgaaaacattaaaaaagtaatggacacaaacgtagaacaaaacgaaagcactgaaacttacaccaatttttttagacaacaaaaaagccagtaacctgagttactgaccatgtatgtattgataccttgtatactctcttctcaacaattagagtatacaaggtattttttttgtgtttcaagatcaagtacttgtttgcctgaattgttgtaattttgaaaaaacagacgcgttggcacacaagggttagagccattctaaatctaattgaggaaaaagaagacaaagttgctcgcaatgggcgcttttttagtcatcgaaatgtgagagccagccgggcaggtctgttaacatttcaatttcggattgttcttccacaatgacaatcgaaccgtcttctgctcgtaagtacaattttccgtcgaatgtttctatttgatccatcataatcacctcaacttttatatacgcaaaacacccccccaaagcagcaaaaaatgcagttttttctatcgatggcaacaaaatggcaacacacacatctcaatcgcttatatagcataaaggttgcaatcctgccgagggcatcatataaagttaagaggttgagatcactattgcacgatagcgatctcaacctcttttttgatccgttttttttaaaaattagtcggccgattatccataagcaggattggccgactaattttaagttatcaacatgttaaagcttgagtgtttcgttggcgaatctcgagttaaaacaacgattgtcttaatgggcaccctctgacgagaacttggtatacaatttggcgaagttgacggttcctagtccagtggcttgattgtaaagtttaccaggttggccggtgtaatacaggttattattgttgtcagcatcgtcaagcacagtaaagggtgaatcagcttgcaccgcaaattgatagatttgtgggttccaaaagccgattggcgaagttgtcccgctgttcatcaccgcgttggcaccagccatttgtggcgatacaaagctggtgccgccgttgactgtccattgtttgactggaacgctgatgaccgttttgccatccttggcataggcgaggtcttgcccggagacgtaggtcgcgtaaccagtgtaactgtcggcattggctgaaacatcgggaacgtttcgaccagaccccttgccaatgataatttgcggatctttattcactaagaaaccaccgcgcttatatttgagcagatcgattgcccggaaggtgttaacgccggaaaatccttgctggtagcggggagtcgggttcaaaattgaaaatccgccgccgctgccgccataattcgccggtttggtttgtggattgctgtatgtgtcgccccaagcccgttccttatcaatggtgattaagcggccatcggtaattctagtatagggtaatgtggtgccgccggtaatgacttgatatggcgaagttgagaaaacgtggttgaattgtttaagggccaattcacgcggaccatagtcgccacttgcccgaaagactgagatgccctgaacagctgcttgttccaacagcagattaaaggcgtcgttgtactcacccaaagaggcactggcaccttgttcccattgactggcaagctccgtgttgggtgaaaagctggttgaaatttgtttatcacgatcatccgaaacggcctgcataaaggcggtgtaataagatgatgtcgttgaagtgacgttttttaatgataggccgatataagcatcgattttggcatcgggtgcgacggccccagactggttaacatccagcgttgattcaatttgagctgggttcaatcccatcgacaggatcaagtgaccagtcttggcaccgtcaattgaataaattttattaatccggctggggtcggcgttgacaccggtttgctgccaatatttgagcacgtctttggcattaaagtcgtccatggcaataatgccaattcgctgtccttgaccggtcaaaccttgtttatataaatcactaacctgataatgatcagcaaattttaaagcaccatactttttagcaaaactggttttactcaaatcggtatttggaggagtcgggttttgtgggagagatggtgttactgcaagacttgtcttcttactttttggtttcgttgcgtacacaccgatgacactgactgtttgggccgaaagctttgccggtaatttaactttggttcgataatcttttttactgaccttcacttgtttggcgttaaatgcccgaatcaaattcttccgagtgccaacgactttgatggccaagtttcccggatagacggatgccttgagatgatatttccctaagtaacttttaaaatcgttgatgtctgtcgtcgggcggccaaattgactggcaaattcgcccggcgttaagtattgatgataatttggtgaacttggatcgacggtgtcatagacataatccgtcagttgggatgagctttgtggttttaaagcaatatttgccacaactgttttcgatagtgaaacttttggcatcgtgtacgtgttggattttgcactggtcgacacactgccagcaatcacaaaaatcccgctcaatatgcccacaactaatcttttgcccctcatgaaaaccacttcctccataatttgataacatttaaattataacattaattagtccattgactgaattggaaagcggtcataccggaaaattgtacctgcttgtgattaaaaatatatcttcagacttattaattgcttttcggatataaacgtagcattatagtggtgtagacagtaatgtgtccgcttacaagaaagaagggtgatatttatgtatgacaacattttggtaccacttgatggaagtaaaaattctcaacaggcactggaagaagcttgcaagttggccaaacaatttgattcaaagctccagttggtaacggttattaacaacaccaacttctactatggtgcaggggcagccggcatgccgccaagcatgtatgacgaccagcacaagatcgccgagaacattattgacgaagccaagaagtatgctgattcacaaggtgttaaatatgaaacagccattgatatcggcaacccaaagaacattatcgcgcacgtttacccggatgagcacgatgtagatttgattgtgattggtaagtcaggtgtcgatgcgattaaccgactgttgattggttctaccacggcctttgttgttcgaaacgcaacaacgaaagttttggttgttaatactaaaggctaaagacaaattgattcattcaatttaatgattatttggtcgtcttgctcttgttagcatcttcagctttcattttttcttcaagctggctaattgagtaaacaccatcagttgatgaactaccaatttcttcaggcttaattcctcggtaatctggcattccagtacctgcagggattaatttaccaatgataacattttccttcaaaccaaccagtggatcattcttaccacgaattgcggcatcagtaagaacacgcgtggtttcctggaatgatgcggctgacaagaaactatttgtttcaagagcagccttggtaataccaagtaagacaggacgggcagttgccggaattccaccattaacaaccgtgtcaccgttacttatcttgaagtcattgatatccatcaaggtaccaggcaatacatcagtgtcaccaggatccatgatacgaaccttacgaagcatctgacgaatcatgatttccacatgcttatcagccacttccacaccttgcatccggtaaactttttgaacttcatgaagcaggtagttttcagttgagagaacatctctaaccttcaacaattccttaggatcaacagaaccttcattgagagctgaaccacggtgaatgtagtcaccttcagcgactctcattcgagctgtgatcggaacggtgtaagttcgagtatcagattcacctttaatggtaatttcttttgttctttcagcaggattttcttcaattgactcaactgtaccagtaacttcactgatctcagctttaccttttggattacgtgcttcaaagatttcttgaacacgaggaagtccttgggtaatatcggcgttaccagcaacaccaccagtatggaagttacgcattgtcaactgggtaccaggttcaccgattgattgagcagcaacagtaccaaccgcttcaccaacttcaacctcatcaccagtagccatgttacgaccataacatttctcacaaacaccgtggatggtgttgcaagtaaatgctgaacgaatcgtaacttccttgattccaaggtcatcaatcttagtagcctgatcctcagtgatcatggtgtttgcaggaacaatcacatcgccagtcttagggttcttaacggttttgtgagcataacggccaacaattcgatcatacaatggttcgatcatttcgttaccttcagtaattgcactgatagtcaggccacgatcggtcccacagtccttttcacgaacgatgacatcttgagccacatcaaccaaacgacgggtcaagtaaccagagttggcagtcttaagagcagtatcggtcattcctttacgagccccatgggttgaaatgaacatttccaaaacagtcagaccctcacggaagttggaagtaattggcaattccatgatttcaccgttaggagcagccatcaagccacgcataccagccaactgagtaaagtttgaaatgttaccacgggcaccagagtcactcatcataaagatagggttctgtggatcttggttttccaacagacgcttttgaatgtcatccttggcgtcattccaaataccaatgactcgttcataacgttcgtggtcggtaatcagaccacgacggaactgcttggtaaccatatccacctttttatgggcggcgtcgataatttcttgcttatcaggcaactgagtgatatcggtaattccaacggtcaaaccagacttggttgactcgttgtaacccagatccttcattctatccaacaagaatgaagtttcagtcactttgtagatcttgtaaacttcggcaatgatatcacttaagaagcctttcttgaatggcaggattaatttggcattcttcagatgctcatgaatgtcctcacctggttcaaggaagaatttgtcatcaacataaccattcaaattggtttctgaaggttcgttaatgaatgggaaatcttctggcaaaatctcattgaagacaatcttaccaacggaggttaccaaaatttttccaagttgatcctttgtaaaggtcttctttggatatgcggaagccttgattccaacacgtgtgtgccagtgaacgattccgttcttaaatgccaattgtgcttcgtcaggtgagttaaagatcattccctcaccttcgcggccggcttcctccatggtcaggtaatagttaccgataaccatatcttgagatggggtaacaactggcttcccatccttaggtgccagaatatggccggcagctagcatcagcaaacgtgattcagcttgggcttcatcagacaacggaacatggatggccatttggtcaccatcaaaatcggcattgtaggcttcacaaaccaatggatgaagccgcatcgacttaccacttaccagtacgggttcaaaagcttgaattcccaaacggtgaagtgtaggcgcccggttcaacagaactgggtgttccttgataacatcttccaagacactgaaaacatcgtcatcttggcgttcaattttgcgtttggcgttcttaatgttggatgccaaattgcgaccaaccaattccttcataataaatggcttgaataattccattgccattggaactggtaatcccatttggttcatcttcaaatgagggccaacatcgataacggaacggccagaataatcaacacgcttaccaagcaagttctgacggaatcgtccctgcttacctttaagcatgtgagaaagtgacttcaatgggcggttacctggtccggcaactggacggccacgacgaccgttatcaatcaaagcatcaacggcttcttgaagcatccgtttttcgttttgaacgataattccaggtgcattcaggtcaagcaatcgtttcaaacgattattacggttaattacccgacggtacaaatcattcaaatcagaagtggcgaaacggccaccttcaagttgaaccattggtcgtaagtcaggtgggataactgggattgcatccattaccatccatgaaagttcatttccggattggacgaaagcttccaaaatatcgagtcgacgaacggcacgggtccgcttttgaccggttgcattcttcaattcatcttttaattcggtaacttctttttcaacatcgacatcttcaagcagtgtcttgatggcttcggcaccaatttgagctgagaaccgaggaccatattcctgcttcttttcgcggtattcacgttctgaaagcaactgcttcttttccattggcgtgttacctggttcggtaacaacgtatgaagcgaagtaaatgatttcttcaagtgcacgagggctcatgtccaagacaagacccattcgacttgggattcctttgaagtaccagatgtgagtaactggagctgccagttcaatatggcccatccgttcacgacgaacctttgaacgggtgacttcaactccacaacggtcacaaacgattcccttataacggatccgcttgtacttaccgcaggcacattcccagtccttggtaggaccgaaaatccgttcatcaaacaaaccatctttttctggttttaaagttcggtagttaatggtttcaggctttttaacttcaccatatgaccaactacgaatcttatcaggagaggctagtccaatctgcatactttcgaatttattaacatcgaccactagtttgacctcccatttctagtcattactgttgttaacgttggttgatttacttggtgtttcaacttgatcagcaggttgtttagctgcatgatcttcctgctctttcttcttgtcagccaatttgctcaatgcgtcaacgtttacaacgtcgtcatcgtcatcaagatcacgaagttcaatctctttatgactcgcatcgagaaccttcatatcaaggcctaatgactgcaattccttaacaagaacccggaatgattccggtacacccggctttggaattggctcacccttcacaatggcttcgtaggtcttgacacggccaacaacgtcatctgatttgtaagtcaagatttcttggagagtatatgcggcaccataagcttcaagtgcccaaacttccatttcaccaaaacgctggccaccaaattgtgctttaccaccaagtggttgttgggtaaccaatgagtaaggtccaattgaacgtgcatggatcttatcgtcaaccatgtgggccaacttaagataatgcatgacaccaacggcaatcttcttatcgaatggttcaccagttcggccatcatacaagatgtacttaccatctgaaggcatgccggcttctttaactgcatcccagatatctttatcacgagcaccatcaaaaacaggtgttgcaacgtgaattccgagtctgcgggcagccattcccaaatggagttccaaaacttgtccaatgttcatccgtgatggcacacccatgggactcaacatgatgtcaactggtgtcccatcaggcaagaatggcatatcttcttctggaataacaacagaaacagtacccttgttaccgtgacggccggacatcttatcaccaacttgaatcttacgtttttgagcgatgtagacacgaaccatcttattaacaccaggtgaaagctcatccccgttttcacgagtgaagatcttaacatcctggatgattccgccgccaccatgaggaactctcaatgaggtatcacgaacttctcgtgatttctcaccaaagattgcgtgaagcaaacgctcctcagctgataattcagtcacacctttaggggtaactttaccaaccaagatgtcaccatcatgaacttcggcaccaattcgaacagtaccatcttcatcaaggttcttcaaagcatcttcaccaacgttaggaatttctcgagtcatttcctcaggtcctaatttggtgtcgcgagtttctgattcgtactcttcaatatgaattgaagtgtaaacgtcatctttaaccagacgttcgctgatcgcgatggcatcttcgaagttgtatccttgccaagtcataaatgcaacgacagggttttggccaagtgccaattctccgccttccattgatgggccatctgctaagatttcgtcagcatcaactcggtcgccaaccttcacgattggacgctggttgtagttcttaccgccatttgaacgacggaatttcattaatttatatttatcaagggacttgtcgtcacgacgtactcgaatttcacgagcatcaacgtattcaacagttccttcattcttacagatcagtgcaacaccagaatcatgagcggccttgtattcgataccagtaccaacaagtggtgcatgaggatcgatcaaaggaacggcctgacgctgcatgttggcacccatcaaagcacggttggagtcatcgttttccaagaaaggaatacatgcagtggccacggcaactacttgcttaggcgaaacatccatgtaatcgaccttgtcgataccaatttcaatgttgtttgacttgtgacgggccataacgatgttattgacaaacgaaccatcatcattcaatggtgagttggcctgggcaataacaaagttatcttcttcgtcagcagtcaaataatcaattcgatcagtaaccttatgagtggtccaatcaacacgccggtatggtgtttcaatgaaaccatatttgttaacccgagcgtaactggacaaactgttaatcaatccaatgttagggccttcaggggtttcaatcggacacatccggccatagtgggtatagtgaacatcccggacttcatatccggcacggtcacgagtcaaaccaccaggtccaagggcagacaaacgacgcttatgagttaattcaccaagcgggttggtctggtccatgaattgagaaagctgtgatgaaccaaagaattctttgattgaggcaacaactggacgaatattgatcaattgttgtggtgtcacagttgaagtatcctgaattgacattctttcacgaacaactcgttccatccgtgacaggccaattcggaactggttctgcagcaattcaccgactgagcgaattcgacggttacccaagtgatcaatatcatcaattgaaccaatgccttcttgaaggttaaagaagtagttcattgctgaaatgatgtcagctggagtaatgtgcttgaagctcaatggaatgttgtcattaccaattaaaggaaccactcggtcaggatcgttaactgattgaactttaatgatttgaacagtcattggttcagtcacaacggcttcatctgaaggggtaaaggtgtaagctttaaattcatcgttatcaaggaatggtgccaagtccttcataacatctttcgtgacaacggtgcccttttgagcaatcacttcaccggtatcaggatcggcaagggtttcagccagtgtcaaacctaacaggcggttctttaagctcagtttcttgttggtcttgtaacggccaacgggcgccatgtcataacgttttggatcaaagaaacgagcagtcagcaagcttcttgatgaatcagcagtcttaggctcacctggacgtagacgttcgtaaatatccttcagtgactcttcaacacgtgaatcgtcagtgtctttatgaacatctttttccaaggtcaaacctaaactgtcgttgtcgcccaagatgtcaatgatttctgaatcactgccaaagccgagggctctaattaattctgttaaaggaatttttcgtgttcgatcaattcgaacgtacgcgatattttttgcatcggtttcaaattcaagccaagcacctctgttaggaataacagtagtaccaaatgaatcacggccattcttatctttatcagcatggtaataaacgccgggtgaacgaaccaattgtgaaacaattactcgttcagcaccattaataataaatgttccttgatcagtcattaatggaaaatcgccaaaaaacacatcttgcgtcttaatttcgccagtctcatgattggttaattttaaggtaatgtgaagtggagcagaatagtttgcttcgtgttcacgcgcctcatcaacggtgtactttggtgttaataattgataatcgacaaactctaaagaaagcttgccctgaaagtcatcgattggcataatgccgtcgaaggtttccttaagtccctcatgtaaaaaccagttgtaagaattagtctggatttcaatcaggttcggtaaatcaagcacttctttaattcgtgcataacttcgtcgggtacggtgttttccatatttaactaaatgtcctgccaagtttttcacctctccaaaaaattccggaatcgaaatgttacagtttgattacaaatgcactttttagcacatctgaccgggttttgggcaaaaaaaatccaaaaacaagactttcttgcttttggctttttatgcaggccaacccggacaatagatcgcgtcgaccatttcgattcacaacaaatacagttaaaagaataacaatttatagaagtaaagtcaaccttttagaccatggttcattttgaatcgcaatttattttttatcattcactaaagttttgcgttccggcttcttcaccgaaatggtaatctggttgtttctaccgccaacagtgactgagtcgccagggacaatttccttggcaagcaacttggcacttaaattatcctcgagttcagtttgaattgctcttctgattggacgagcaccgtactcagggtcaaaaccacgcttggaaataatcccgattgcagtcttggtaatcttaatgtcaatgccttgatcgtgaatccgcttgataaccggtttggccatcaggtaaacaatttgatcaagttcgtccttggtcaatgagtggaagacaaccacttcatcaattcggttcaggaattcaggacggaagcgttgtttgagggcagcttgaatcgtgtccttcattgctgcatagccttccttggcatcctcttgaccaaatccaacagtcttcttatcccgcaatgtggttgcacccaggttggaagtcatgatgataacggtgtttctgaaatcaatctttcgacccttggcatccgtcaagtaaccatcatcaagaacttgaagcaagaggttgaagacatcaggatgagccttttcaacttcatcaaaaagcacaactgagtatggcttttgacgaaccttttcggttaactggccaccttcatcgtagccaacgtagccgggagcagaaccaatcagacgactggttgaatatttctccataaattcactcatgtcaactcgaatcatgtcctcttcagaaccaaagactgcttcggccaccgcctttgccaactcggttttaccaacaccggtcggtcctaggaacatgaaggaaccaattggacggttcggatctttcaaaccgcttcgagcccgacgaatcgaacgagaaaccgctgaaattgcttcttcctgaccaacgacccgcttgtgaagaatcttttccaagttgactaagcggtcagcttcggtactgctcaaacgagtaaccggaatcccagtccactcgcccacgatttcagcaacgtcttgtggcgtttccttaacggggtaatgcgcatcctctgagccttcctcggaatcattatcttgagcaagttcatcctgtaactgattcgtttgtttgcgaatcttagcagctttttcgtaatcttgggctaccaaggcttcatttaattctgataacaaatctgacagtttcttatgatcatcaacggcatcagatttttgaaggtgatcaattcgaactttggcagctgcctcatccattaaatcgatcgccttatcaggtaagaatcggtcgctgatgtagcggttggaaaggttaaccgcagtttcaatggcgtcatcagtaatttcaacgtggtgatgttgttcatactttggccgtagacctttgagaatttccaccgtttcatcagtcgttggctcatcaaccataactttggcaaatcgacgctccaatgcagcatcagattcaatgtacttttggtactcgtccaaggttgtggcaccaattaattggagctcaccccgggccaatgccggcttcaaaatgttggaagcgtcaatcgcaccttctgcaccaccggcaccgatcaaagtgtgtaattcatcgatgaacagaataatgttgccatcttggtaaatttcatcaatcactttcttgagtcggtcctcaaattcaccacggtatttggtaccggcaaccagtgagcccatgtcaagcatcatcaaacgcttcttggacatgtcaccaggaacgtcgccgctgacaatccgttctgccaagccttcagcgatggcagttttcccaacaccgggttcaccaattaaaacagggttgttctttgtccgacgagctaaaatttgaatcacgcgtttaacttcgagatccctgccgacggttgggtcaagacggtcttgacgggccatttcagtgaggtcacgagccaatgaatcaattgttggtgtctttgagtcagctggcttttgttgacggccacgttgtttggaagccaggcttgaggccattgagccaccactgatgcccatttttcgaagggttacttttctaatttgtgatagatcgagtcccaagttaatcagaatacgggaagataaaatggtctcatcagtcagaagtgaaagcaaaatgtgctcggttccaacctttggaacaccgttcttcttggcgaattctcctgcttgagccaaaacttcctttgcctttggagagtatggtagataatcgttactgctaaggtccttaaggttgccatagccggcgaaacgctctacttcttcagtgacatcttcggcagttactgaaaactgctgaagcgccttgtaggcaattccattcgtttcgatcagtaagcctaatagaagatgttcagttccaattgcttggtgcttgaatttcttggcttgttcttgtgcaatggtcaaaacgttcttagcactcggagtaaataaattattcatagataccctctctttctatcgttcgtatcgcagccggttcaatatcgacaccatgatattggcacgtaaaatgtcggttaaatcgctgttattcaggtcaattgcatctttgtcaatcgcagctaatatgatgctcacctcgcgacgattaattaattcattattatataacgtttgaacgatcgtttcactatcccgcttcgataatttgttaccaattgcggcaattaatgaattcaaaacgtcaatgtcatctaataaatgaactttttctattctaatgtagccgccaccaccacgtttactttccacaatataaccattctggatcgtgaaacgcgtgttgattacatagttaatctgagacggtacaacgtcaaacagcccagcaatttcagaacgacgaattttaacctgctcgttctcggcaaggatttctttgagataatgttcaattaaatcagaaatgttttcgtccgccatgtaatcacccaattctttgactaatattgactattattatacgaatgtgacgccaaagtgcaaggaaagtgtttgagagtgcgacatgccctgggtgaccccggagcacaaagcggaaacatcaatggtgaacgaaccttgttcatcgttgatgtttccgctttgtgtggtaggggtcaagggcatcggagcacgtttagagtcgggatctcttcacttatgcagtaggactctggggtgtcggagcgtattttcgaagtgggataaagcagaaagaagcaaaacgatcgtgcatttaaactgacccattctaaaatcaaaacataccagaaagtcacatcaacaccagcaaccacgattgccgttcgccgagatgtcaaaaaaggccagaaccaaagtacagttctgacctcaaacacgattcaattaatatgtaatttcccacaaaaaaatcgggaaaacaagatttgaacttgcgacccctacgtcccgaacgtagtgctctaccaagctgagctacttcccgatgatttaagtactattgagttaacaatataaatataccatatgatctatgttaaacaaagtcgggaagacaggattcgaacctgcgaccccctggtcccaaaccaggtgctctaccaagctgagctacttcccgaaaaggaattcattgcaataaaaaatgcacccagtaggagtcgaacctacaaccttctgattcgtagtcagacactctatccaattgcgctatgggtgcataataagtattaaattaaggaacctcaatcatagtacttgattgaagcggaagacgggattcgaacccgcgacccccaccatggcaaggtgatgttctaccactgaactacttccgcaaaatgccgactagacgattcgaacgcccgacctcttcattactagtgaagcgctctaaccaactgagctaagtcggcaaaatgtataaattgttaggtaactagcacctatgcgggcgaagggattcgaacccccacgtcataagacactagaacctaaatctagcgcgtctgccagttccgccacgcccgcattgttaaaaactggcaatgagccgtggcagtctcgaactgccgaccctctgattaaaagtcagatgctctaccaactgagctaacggctcaatggaggatacagggatcgaacctgtgacctcctgcttgtaaggcagatgctctcccagctgagctaatcctccatgaaactaaatgaatcaaatgttggtagcaacatcatcaacacaactattaaattttacaataccaatcaactcaagtcaagatgaattttaaaaaatcctgattggttagccgttagttaataacgtctttttccgacaaaaaatattatatcctatctcggaaaacattgctagtccaattttgaattaattggatttttattcgtgataaataaaaaggcgaaggacagtcagccgtccttcgccttgctcctggtacgataatcacgcccacattcaaaattcatcatgcggtaggattgatttcatccaaaaactagttttgcttttcaattttagtcatgccgtgcatatatggccgcaatacttccgggatcgtgacgctgccatcttcattctgataattttccagaatggcggccaccgttctgccgactgccagtccagaaccatttaaagtatgaacaaagtgaagcttcccttcatcatcccgatactggatgtgtgctcggcgagcctggaagtctgtacagtttgaacagctggaaatttcccggtacttatcctgggctgggaaccaaacttccagatcgtgggtcatagcggctgtgaagctcatatcactcgtcgtcaatgtaataacgtggtaagccaacccgagtttttgcaggttaacttctgcttggtgggtaatctcttccagtgccttccacgagtcttcgggcttggtaaatttcaccatttcaaccttgttaaattggtgtaatcgaatcagccccttggtatcacggcccgcacttcctgcttccgatcggaatgccggtgacaaggccgtaaccgataccggcagcttttctgtcggaataacttcattgcgataatagttaaccaatggaacttcggcagttggaatcagggttaaatcactgtcctgaatctcatagccggatttgttctccaaaaattttggaaattgcccggtgccatacattgaatcattattaaccatgtaaggtggaatcacttcggtataaccggcagcggtattttggtcgaggtagaagttgtaaacggcccgttccagtaaagccccgtcgccaatatagtaaacaaaccggctgccggacacttttgcggcccgctcaaagtcaaggatgccaagattttcaccgatttcccaatggtgttttggttcaaaatcaaatgacgggatctgaccaatcttacgaagctcaacggatccttcttctgtgagtgacaccgggacatcatcatgaggtatgtttggcagatgagcagccaaattgtgttcatcttcctcaacttgacgcaattgctcgtcaagttccttaatccgttggcccacctgtttcatttgattgatggcctcagttgcatcctctttattgcgcttcttttgtgaaatctggtcagaaacggcattccgctttgctttgagggactcggattcaacgatcaaatcacgacgtttggcatcgtagcccactaattcatcaatggtttcgggcttgattccccgcgtagcgagcttttctttggtaaaatctggatcttttctgattttcttaatatctaacatttcaaatcctcccaatctgtatacaaaaaggacccctcgtctatgggacgaaggatccttttcgcggtaccacccaagttctcgacaatcttgccgagctctcaaagtatggtaacggcatacaccgtgcagcattacctgcccgttcacttgtgctggaatattcgatgacagttcacaccaaccactgtctctctgaaatctacttaataggcacaaaacgttttatctgaaatcgattataacgaatcaatccctaaaccacaagagcggtctgaaattaaattgccaacttatccactttggcgtcgattagatcgatcaccttgtgtttatcggcatcattttcaacaaaatcatacttgtcaccgtcaatttgaatcttaggtgatttgtcatattcttggtaccacgtctggtagcgggcattcaaatctttatagtattggtacaaatcgggatcattatcaatctgctcataagaacggccgcgcttttgaatccttcttaacatcgtttcaaacgagatgttaatgtggatcaataaatcggggttcttgctgtgatcggtttgtggcatctcctgcatcatgttctccagcaatgagtcgtaaattgtcacctcagtttcggtggcccggcccaagtcggcattcaaatggaagaggagtgaatcttcaaaaattgaccgatccaacacactctcgtcattttgccaagcttttttaatgtcatccatccgacggtttaaaaaatcaatttggagcaagaaggcatacttcttgggatccttataaaacaacggcaggatccggttgtgttcaactgattcataataggcaggcgtgcccaaatgttgcgacagcatcttggtcagtgatgtctttccggcaccaatcgttccagcaagtacaagcataattattcccctaacgtttttgcgtgcaatcatcgcacaatattttatcaacgctacatattgtactagttagaagagataggtgcaacatattgtggaaatttagttaatgtttgagacgtcaaccacttggatgttgcccaaaccaccgtacgcttcaaaccacggtgtggcattctcagacaagatctgggttaattcagtgacgtttctggttcccttgcgtttgagccagtcaaccaggccgtctttaccgtcacgaatgtaaatgtcgacaccttccaaccaagttgcccgaccgcttaagacaccgttaaacttggcaccggcatctccagccagcttcaattcccgttggaaaacaggggtcggcacaccggcactcaagaaaataaatgggcgggtcgcctcgtcgctcaactctttgagacagcccttggcttggtcttcggtgtaggcgtaatcgccaccatcagcccattctttgacgtaggtcgggttaaatggaatttccatcttcaaaacgtcaatgtgatatttctccttggtgaattccatcattgactgcagcaccagatcaggcttgatcttggcaaaatccaacgacttgctgtcgtaacggtcgtcgtaagtgacaatttcaaagaaggttggcgtctgggctgccaaaccttccgtcccgtatcgttcagcgaacgcttttttaacgtcgttgatttcatcaggatcattgggattgtagtagaccaataccttaagggcatctgctcccttctcaaccataatttgagctgattgatcagaaatcaagcttggtaatcgtcccggggtgtcggcatcgtatccagtcttttcataagacataatcagaccagtgtctttagccttggcctggatccccttgaaacccatttgttcgtccaaaagcacggcagaactcagtggactcaagatttcagagacaatctccttgaaatcatagaccatcttcatactgaaaagcttcccgtatttttcggaggccgttttcattcccttaacaagtgatccacgttggtctaacgccaatgcatcgataatgttctgatcattggacaatttgttcattctttcaaatttaccttttgacataaactttttcatatatctttcacctcatatttttaatataccaattggtaaaattgtaccaaacattatgccccaatatcaagttttaggccgataaaataataaaaatcggcccatccaagacggatagaccaattcattattaatatattacttgttgttcaattttgaaagatcctcgtctctatgggccgggggaacgtcaacctgatccagcggaatgattttcgtatggtgcttgagcttataccaaatgtacaaaatcaataccaacggcacgctaatgtaagtgaccagaatctgcttccagtcaaagcttgcaaaggcctgcggattttgaccgacaattaccagaatacacaaaatcaggcacaatacaggaccgaacgggaagagcttggcatgatacttgagttcgctgaggtcatggccctggcgaatgaacgcccgtctgaatcggtaatgtgaaatggcgattccaaaccatgcaataaagccggttaacccggaagctgccaccagccacatatagatttggggcccggcaatactggaaataaaggtcaatagcgaaacaaaagtcgttgccaataatgaataatatggaatcccattggcagccgttttacccagggattttggcgcatatccgctgttagacagtgaatacagcatccgggtagaggcgtacataccggagttcgccgatgaaataacggaggtcaaaataacggcgttcatgacactggcagcagcggccaaaccagcccgctggaaaaccaatgtaaatggactgatcgcaatgtcagtggcacttgatcccagcagtgaatggctggtgtaaggaataatggcggcgatgacgaaaattgtcaaaatgtagaacaaaataatccgccagaacacttcattaattgcctttggcacactgtgttggggatcttgggactcgccggcagtgatgccaaccagctcagttccttgaaatgagaacccggcgaccacgaagacactcaggattgccggaaaaccgccgacaaatggtgcctgcttaatagaaaagttacgcatgccgacaaaatggccgcccatgattccaaagatcgtcaaggcacccactaccaggaaaataataatcgtgaccactttaatggcggacatccagaactcggtttcaccgaaggtactgactgacatggcattaatcaggaaaataatcactaaggcaattgcactccaaatccaggcaggcacatttggcagccagaatttcataaccaaagcggcggtactaatatcaacagccaccgtaatcgcccagttaaaccagtaattccagcccatggcaaatcccaaggctgggtcaacgtatttggatgagtatgcggcaaacgagccggaaatcggcatattagtggccatttctcccagactggtcatcaggaaatagaccatcatccccatcaggacgtatgccgttaaagcaccaccagggccggcttggctgatagctgaaccactggccacgaacagcccggttccaatacagccacccaaagcaatcattgacacgtgacgggcttttaggccccgcttgacttgtccgttggcttcttggctctcattatcgttcatcttttcgtctcctatatccaataatttcaaaatctcgctaaatctacaaaaaaatccctttcaaaatattgaaagagacagtttgcgtttctcaacatcttgatagctctccgcgatttccgcgacagtccccagcttcttaaactgggccccaacaaccaactggaaggcagctgatcgtttcggcactcatccctttttacttcagtcataacttccttcaagttcctgaaatatactcttgatgaatgcgcctctactcgattagattgattaatttagttgttaataacttcgacaatcaaaattgtaactcacttgggttgaattgacaaaccagaaagacttttctcaatgcaacgccagctgataaatggtcttttctttgccgacaagcggatcaatcagtgtggtcttcacttgaaacccgaccttctttaagacacccatagaggcttgattatcgctgaacacctctgcattcaacgtctcaatcgttgggttaacagcgagttcctgaattaatttagtaagggcttcagacatgatcccttgacgccacagttccgggtgaagaaaataactcagttccaaattggcaggatcgggttggtgatcaaaaccaacttgttcatataaaagaattgccccgaccagccgatcgtggatccggatgccaaaggagttaggcgttgtaatctgtcttttggccactgcccccagcatttgttgattactgaccagattaaaaccggcgccggcggcaatttctgggatgctgattaatttttcgtaagccgttaagtcagccagcgttaattcagtcagttgaagtcggttggtctcaatcggtaaatccatggcgatctcctttcaaaaaaatgcccaggaaaaatcctcggcattttcaatcagattttagtgtgaaccacaaaccggtagcgggcaacctggggcgcgtaactggcataaagcatttcagctaccaacagccaggaatagccaaccaggcaggctcccaccgtatccgttgggtaatgggcgttcaagtagacccgggaaagcatcaccaacgccaagacgatgacgagcagtactttcatcaccactcgaatggacgcccgctcaatcaacggcaggacgatgatccataacaccccggcaaccaggaaaaatcccaggacgtgaccacttggaaaactgtagccattatcgacacccagatgcagcggcggtcgatgccgtctaaccagttgtttgacgactgcgccaatcacgtcgccgccgactatcgtccctaatgcccaaagtgcgggaactttgtacttaaatccccaaaggaaaaaggcgatgatgaacacccagaaaatgtccattttcgggctggccagaaatgtgattactgagtagaaatgttccagtcccggtgtcggcgcggatccttgaatggccgttgtaaaaattgaatctaaaaattgcaaataatcaaaattaaacgctaccgaaattgacagcaaggtcgtaaaacacaaactcacaatcagcttgaccaaccggtttggatcgcgttccatcagcatgtaatcttcgtttccgtacattagttcaacaaccctctcgtatgtattactcaaaaatgagtatatcacaaatcgaaaacccggtttctggtttctgaaaattcttagctatcttttaattatttacagaaagtgtataatcttgtgagttagagatcacatttaaaaggagtgaaagacttgataaactatgctttattgatgattgccattggcgtgttcgccgggtttgccggtgccatcctcggcctgggtggtggaatcatcttaacgccgattttgacattgttgatgggtgtcgacattaaatacgcaatcggagccagtatcattgccgtgattgccaccagttccggagcaacgattgcctatctccgtgacaaagtgctcaatttgcgggtcgcgatgtttttggaaattgccaccactttaggggcattgagcggcgccttgttgaccggtgtgattgatccgaaatatttgtacatactatttggattattgctattattctcaggctacaatatgattcgcaaattaatcagtcaccaggaagtccttcatcgggctcatcccgatcaattatcgtccaaattcaagctggacagcagctacttcgataatgttgaaggcaaaacgatcaactaccaagttgaacacattcccggcggcttggcagtcatgtacggtgccggcattgccagtgggctgcttggaatcggctcgggtgctttcaaagtgatggcaatggacaccgttatgaagatgccgctcaagccatcgacttccactagtaatttaatgatgggtgttaccgcggctgccagtgccactgtctatttcttcaacggctcgatcaaaccaatgattgccgttcctttggcactgggaatcttggtcggcgcccgcggtggttcacgaatcatgcgggatatgtcagcgcggacgattcgaatgattttcgttccgatcttgttttatatcggtatcgaaatgtttatgaaggggatcagataagatggacaaaaataccagagaacaaatgactgaagaaatggccgacgtccaattgattatcggcaagattcttcggttgggggtcatgatttctgcaaccgtgatgatcattggcttggtgcttttaattgtcaaaggcaacggcggctatcctcacaatgcctttcccaccgactttacccaaatttgggcgggaattgccgaactcaagccgtacgccatcatgatgctgggaattttcctattgattttgacaccggtattgcgggtggtcgtttcaatttattccttctatcgcgaaggtgacagcttgtacgtttggatcaccacaattgtgctggtgattttaggaattagttttgtgtttggaattttaagataatcaattaacaatcaagaggcgccggtaagggaacattccctttgccggcgcctcttttgagttgattaacatttttaactctggtgaatcgtgacatcgccaacgtcgctggtaaatctgtaagtcaccggatttttggcattgctgtcaatcttcttgttgtgtgagctgccaaacaatgatgcatcgccaacatcggcactcactgaaatctgcgttcgcttgttcttaaccacatgtcctgaaatatcgccaacgtcgctgtgggcggtaaaagacttgccgactttttgggaattgaaattaatatccccggcaccggtttcaacggccattgagtcgaatttattggacgtcagatcgacatcgccggcaccaacatcaagatgtgcgctgggaaaagtgctggttgttaaattcacatcaccggtattctccaagtccaagttttcagtggtcgtcacgtgattcaaattaacatcgccgaccccagacgaagtgatcgtcttgatggtcatattcttgatagtaattgagttggcaacatcactgttgatcgtaccgaccttcatgcttcttggaacggtgatgatggtcttgccaaaggcctggcgcgctcggcgaaaatcaccaaagaagatgataccatggtgcttacgtggactttttaaattgaaatgaagggtattgcctgattgcgtgatcttggtagcacttggataagtaacctcgattttagaaacgttacccttcttaatttgcaccggactggccgttgacaaagaaaagtttttcacgccggaaaatttggcactggtttggtgtgacttaaccggcgtggactgatcagttgtgaacccgtgatcccaatagaccgtgcgggcaccaccattgcctaggccgagcgccaacagaacggttccaaccaaggtcacagttaatcccacgatgacagtttttttcatttttggtcaccctttccttttcgttcagcccggttcttcgggacaatcttgttataaatccatttcgaaaataacgtgataccacgaatcagaccgttgatgacggctttgaagaccggcaccagcataatcatgaccccaatgaccatcagacccattcccaaatagaaaatgcccgtccaaaacgaactaaacagggtgcccaatccgacgacaaacccggtaataccaaccacgaccaccgcaaagaagatcgccaaaacggcaataatcagtgaacccgaaactgcgattccggcaaaaatcacccctgcaagcgcaagtgccagcggaattgtcactggagtcgaaagcaatgctaaaataatcagccaaatggttttaacatcatttttcggttgttgctgtcgagactgctgagacatcggtgcgtccagtgtccgaatggaataatctgccaacaccttccgagccaattgatgaggcgttcccaactccctgatgcaatcgtcgtaactcgcatagccgccgtcttgaagatattcacggtagaaatcgactgcttcatcccgctcttcaggactcaattgtcccagcagtgcctgaaactcttcaatgtaatcattcattctgatcatctcctaacatgttatcaatcccttgcttaaattcctgccactcctgctgaataatgccaaactgtcgttttccttccggcgtaattttataataccgtcggttgcgaccctgatatggctcatcataagttgtcaacagatcgttcttcttcaaccgtcttaaaaccgggtacatcgtcgactccgaaacagaaatcgactcttggaccttctgggttaacgcgtagccgtaataatcctgaccattcagaattcccagcacacatccatccaacaattccgaacttatttggatcgccatattgccacctccatagtattatacgcggtataatattatccaagacaaataatacgcctctaaccaggaatgtcaaacaatttatggcagaaaaaaaggatgggttatttatcccatcctttagacacatatttaatcttaattcgaattttgttaatcaactcggccacgataaaccccaaggcaatcgatccggcaatccagacgacctctgaaagataattaaaggccacctgataatcacctaatgcaaagtttttaatcgtgttatacgcctgacccccaggcaccaatggaaccaagccagggacgtcaaataagatactcggcatttttttgaggtgggcaatcaccacggacaccaaaccaatcgtcaagccgccaaaaaaattagcagctcccaatccaccccaggtattcatgacgccatagtacaccagccaactcaaagtggcggtgatcccggcgacattcaaagcccggtgtggcaggttgacgattaggccaaagccaatgcctgaaaagtaaacacaaatacatttaataataaacagactcataagcatccctcaaaagaagtgcagcgcgattgccacaccaaacccaagcgcacaggcactaatcagggcttcaatcccccgtgccggaccactaattaagttgccggacaacgcatctcgaaccgcgttggtcaagggaattcccggcaccagtggcatcatcccgccaatgataatatcatcggctttgacgccgatcccatttttcacagcgatcagagctagtgcacccacgacaactgcggccaggaactcacttaagaaccgtatttgaatataaatattcaaaaaatagtaaactgcccagccgaacatgccgacaataaacgtgatccaaaaatccggcagattgttttgaaacaccacgaccaaggtgccgctcactagcccagcgcccaaggtctgcaaccagagcgggaaagttgctaccaagtcatcaatgtggactaaatcgtcacgaaactcatagatatcaatctttttggcagcgtaggccctggacaattcattgaccttggctactttttccatgtcaaaagcccgtttgtcaatcgaaccgacttcggcgccaacttccttaacgccgcctgacatgataatcccggtcaaagtcgcgtagacttgggcatcctttaacccggcattcttggcgattcgcataattgtgtcgttgacccgggacatttctgagccggattcaatcatgatccgtccagccagcacacaggtgttcaagactaaatgatcataattctcctgccgagttgcagtatcggccatttcaatcacctcacgaaaacataatgagccgttttaaagccaatcaccaattttttcttatccgtcacattcttgacggttaccgacccttcgaagggattgtgagaaataattttcaacttatcgccaatatcgagcttaatatcgcccagcaacgttaataagtcatgattgtcaataaatcggttaacgatgacttcttcaccgtcttttgcatcagtgagcagtttatcatgatcggggtgataattaccattccgatctggaatgacgccgccatggggacaacgcttgggattgcccaaaaagtcatccaggtggtcaatcatcttgtcggacgtgacgtgctccaacagttcagcttcatcatgaacgtcggaaatgtcatagtgcagcgtgttcaccaggaaagtttcccaaatgcgatgcttgcgcacgagttcttcggcataacgcttacccttttgagtcaattgaacaccggaatacggttggtgggtgaccaatttttcagccatcatcttattcaccatttcggtcactgacccggcagcgatgtttaaactgagagcgatctgcttgttgctgaccaaatcatcagttccgccaagttcaaatattatttttaaatagtcctctttcattggggtcatttaactcaaaatctcctatactttatggaatatcattaccacggtcataaatgatgtcttcgtgctcaccacgggtcgtttctgcttgaatcgtcacgtgacacatgtggtacttgtccttcaataccttgctgatttctgaataaatcggctcagcctcactcaacttcatatcatgcatattaacgtgggcggaaaagatcacgttgttttcatcaattgaccatgcatgaacgtgatggacactgaagacaccgtcgatttgcaacagatcttttttaatctgatcgtaatccaggctcggtgccccctgcatcaaaattcggcaggtttggcgaataatcgggatcgactcatagaaaatatacacggcaaccaacacggtgacaattgggtcaaccaatgtccaattataaagatcgattaaaattccaccaataataatcgccacagacgacagtgcatcactcaagatgtgcaggtaggttgctttcatgttaagactgcttttggaacccgagttcagcagaaaggccgacagcaagttagctgccaaaccaataaccgcaatggtcagcattaaattaccgttgatcggttcgggtttgctgatccgtttgagtgcttcaataatcagaattacacaaatcaaagccaaggcaattgaatttaagaatgcggcaataatctcagctcgtttatagccaaaagtattgcgcccgttttgccgccgtttgctgattcgactagccgcgtaactgaaaacaattgaaaccgaatccccagcgttatgaaaagcatcagaaatcagtgacaaacttcctgacagcgccccgccgatgaactcggcaatggtaataacaacatttagcacggtcacccagaaaaacttggcaccggctaattcttcgtgattatgatttttttcagccatccattaatcactccaatctactatcattattgcattagttcatgaaaatttccataacacgtgaacaatccttttagggataccagaaaatcgctctactaagccgttgaaaatggcccgacagcaatcgaaagctaagccattcctgcagaaaacctgtctcggtttccgtcccgagttttcctgttattttgattaaacctgcgaaagaggacagcaatcaaaagctaagccattcctgcagaaaacctgtctcggtttccgtccggaatggcttagcttttgattgctaaacgtcctctttcgcactctattaaaatttatccgccaacctcctggactcaatttccgcatccgcgacgatttgttctgcttgatccgggaaatgatccattccttcaacacttaatttagtcactgactgaacgccgacaaaattcaaaattcccttaacatactgagtcccaaaatcctggttattgtacttgccgccggccgcctggatatggaaggcttttttgccgctggtcaacgggactgcagttcccgtatcagtatatttaaacgtcttcccggcgacattgatcgtgtcgatccacgcctttaatttagttgggaccattaaattaatcaagggatttgcgataaccactttatcagctgccaaaaactggtcagttgaggtattaaattcagcgagcttcacttgttggatcgacgttaagtcgctaaactgtctgccagcttcaagttcatcccacgcagaaaaaatatcgccgtcaatttcttgaaaatcaactttgtacaaatccaatttttcgataacatcatttggatggaccttcacatactcatccataaacgcgttcaacactttcaatgtccgcgactttgggctttcgggacgggcaatcaccactagtacttttgccattattcaagacctcttttacgattcaatcgggttgtcaactccgataatatagcatgatttcgtgggaatgacaacgctttcattttctagtaaaacatggtcgctgttttggtggggactgctttgcttctctctagccaaaatgtgctccttggggcaatgatggggacctaagccaccttctggcaaagcctgactcggcttcacccgagggtgcttataatcttattgctaaacgccccttgtcgcactcttaaaaaagggcccagtgcactctgcactggaccctcctgcggggaatcggccactctaatggttttaatcaaatatcacttcgttcatattcgaatactgatccggtttataaccgaatactcaaagtgcttttattcgcacgatggaactcttttgtcacattacttgtgcaatctaacagttatacaaacgatcatctaattaatgacttaaagagtgccgataccccacgtgtttagaatatcattcaattcttggtttaacaataactttgtctagatcttacaacgtttaatcagttgtttgacgtcttctaccgacgagccattttcaataaaacagttgaccatttccatccagtacatatcggtgtcgtcaaattctgcaccgactgccacttgaggcttgcttggaaccaggccgtttttgatataatcatcaatcacgtcaggactgacgttaaatttggctgccgtttcattcaatgtcaatttcataaccgttactcccaaatttcgttaaaattcaaatcaaatgatagtctaacagcttaccgacaaaatgcaacagcgaattattcgaccatccgccaattgccctcatcggctttcgaaatttgatctaagaagtgcagaatcgacgctgccaagtccttgtcatgctgaaccagcatattgagcgcctcaccggtaataatcggattactcaacgaaaattgctcgccttttttctcaccggtagagaatgccaacaccgtgttgccatcatcaatttcagtaataatgaagaacatactgaaatcatcgtcatctttcatataggcaggcatcgcccaaatcccatcactaatttcaaccaattcttcattgttgaatcggtaatcccggtgattctgttcattgactggcttatccagcacaaacatcattttgtcaaaaaccgggttgccaagcttaatattatcttccatcgaattcccctttgcattcatcataattcaatcacgcaaaaatcattctactgataattaccggttcatgcaagttcaatgaaaaagccagtcgatgaattattctttatagaccttggtggtgagaatttcataaatcgccatcgtcgctccaaaaaatagcccgcttctgacgtttggccaaatcactcccatgttttcgacactattgagtggactggtgccgtcaaagtaccaatccattaaaatatctgccatcaacataattaccatgaagtatattccaaaaccaattcctttcagaaccgcttttttgatgatctcctgccgactggtcgcttgaatctcacgcgtcacaatgtgtgcccgggtagtcgcaattaagatataaatgtttaccacgaagccaaccatcacaatgttaatcatgaccagacccatcagtgcttcttctgggtgcttttgacccacaaaaatggcgacaatgctcgaaaccaataggtagactgccaaaatcatataagcgttggtgccaatcctgccgatttgttggtgcttgtactcgtcgaatggtcgtttgaccccaaaccaatgcatcaataatcttgatccaaaactttctttagctttcattattttctcctcttgacatcagattccaccacaacgatatggttgattgcttctcgggcctcccagacacaagcgaccaccaagaataagaaggcaaagactcctgggaagggccgatcagccggactgacgttcatccagacagcaaataggaccaccccgccgagaaaaccaacccagacgctgcccatgaccgcatcttcaaccgcgtcatcatactggttggcaatcaccttgcggatatccaaacccaggtcagctgcccgccgtcgaatataaaggccggagccgcccacgccaatcaatagacttaaatagacaaacagcatccaagattcgctattgggggtattctttacgaacagtaaaacaccaccgttgaaaaccaatatgtataaccacatgaataaaaacgccttggagatgacggcattcatttgttgccgggcgtctttgtctaacaccccgcgaatgtgaaaaaagtatcggaataattttgtggaaatcgtatcgtcttgtcgcatgattttcctcctattcaactttgacaatgtgggcaatctctcgatgagtatcagatgtccaagaaatcaaaacaatgaatatcgcaaagccaatgctaacgatcgagaaaaaaccgttaaattgagcaaacatcaaatacgtaaccaatccataactgatgccaaaccatgcgccatggatcacggctttatgaactgcctttagatactctttagttgagacttcttgataattcagttttaattctgaaactttatgcgtgacgtaaagtcctacgccaccccatacaataaacatattgaacagaataaagccattgatcattgacccggtcttaatggcctgtgggagaagcagaaaaacggcattagcaatccctgtatacatccacaaaaacataaaggcgtttgtggcgaccttgccgatttctcgagcattatgctcatccaatacgccgcgaatactgaaaaagtatcgcatgattttaatcaagaaaccctctttcatgaattttcatctaccttccaaaatagtgtgtttaaatccgtccccaattcttccgccaagctgatacacaattttaacgacggattgtacttatcattttcaatcaaattgatggtttgcctggccaccccgactttttcagccaaggcaaattgggaaatgcctacctgctttcgatattcccggactctgttcaaattaacccgcctcccctggctgctttgtcacatatatgtgtcatcaataatataatgctactggcagataatgtcaactatatatgacaaaaaagagtgggacgcgaggcgttttgatcccagaatttaagcaaagaaacgagttattcctgtcttggaatgactcgtttctttgcttaaatggctgggatcagccgatagttccacgtttaaactagataacagtggaacgcaagagaggccaagacacaacttccaattagttgtgccccagcctctccttgagtattcttacttttatttagctgaatcgtggaaaaatgagcagcttccgggcatataaggggggcaaacaaatatccaagccctggatatttgtttgccccccttatattctggaagctagacgctcatttttccacactatttatacatacaacaaactccgctgcttggcggtcttttgcatatgatcgtacaagtggtcaccaatcatctgagtacccaccgtcttaaattcttttcgttcatacaatttctttgcttggggattttcaaaatccacattcaagccaatcaccgacttaccatcatttaaagccattcgtggcactgcagccaataatttactaccaattccatggccctgccaattaggatcaacggcgatggaatccaagtaccattcgtcagaattggtctcggaatcagggatatacggctctttaaaatcagcactctttttcgataaattgatcagaaccttattaatagcgtcctcattttcgctggggtagccaaagacgaccccaacaacttggccattggcctcggccaccacggtggatgccttactggacagatacgtgtctgtctggtaagccctcgtgatgaccttggctaatccaggttcgggaacgtcttctaattcatcaagttccatctcatcaaaaataatatcaattaacggggctatctggccggcgtcatcttgctgtgcttctctaacggttatcaaaaaaatcctcctaagtaaatgaacattcagtatgtgttacatcatatattactgaagttttcatttattgtcaaaattgaggatgaaactactgatcattttcagaatggttttcatgaccctgctgatcattttcattcagattactcttggggttgccaaactggtttcgttgaatcatgtccaattcagtgcggatttggccaagaatttcaatttccaatttctggatttccaaagaatgtggtaattgattttgggttaaattatccaattttgcatgtaagattcgcagttcatgttcagatttctggttaacgtgataatcattttcagagctcatccgatcacggtcggcagcccggttctggctcatcatgataattggtgcctgaatggcggcaatacagcttaacgccaagtttaagagaataaatggataaggatcaaagtgcatgccaaacaactgcaggccattgatacacatccaagcaattaacacaaacgtaaaaacgccaatgaaaccccaactaccaccgaagcgggcaacggcatcggagactttctgaccaaacgttaaactcttggccaaattatcattgacgtcaataatatcgtaatcatcactctgcatcgccttggtcagtcgacgattaatctttttagtctgcttgacgtcggcattcaccatcccatcgacgcgcattaattggtacttcagtaagtcatggtcacaaataaaatcggtaaccttggctttcggataatcccccttgatcaaatttctggttgccggctccaaatcctttaggtatcgaccatcgatcaacatatgctcccggtggtcgataaagcaaatcgctgttttagcttctggcatgttctcaatccctccctaatgtatgtatgcaaaaaaaagaatgtctcaccgattattatatcagtaagccattcttttcaaatcatttaatagtcgtctaaaactagcgcctaaccaaagcgtgaaacattatgccttaattaaatctgattttgctttcaacaaagcggccttcaaagcacggatgtgctcgcgggtttgcttgtcttcctctgccgccttcatccatgataatacagacaagttagtttccatctcagcaataattttttgaaccgtctgatccgattcaccattggtagacatatctagtctcctccttaagttgatacccatactataccagaagtatgtgaaaatacaacggaaatgaacccgctttcatcgaattctaatttgaaattaacgcaagccgatcaaccattggtcttgcaatgttcatttgtgcacaatatgagtagacctctaatgaagaagtgctgaaatgtcttgtgggagttgagatttaaagcttaacgccctgttggaaaatggatcttcaaaattgagctgggtggcatggagtgcctgacgaccaattcccaattccattgggccgtgatacagggcatccccaagtaacggatgatcaatcgaagcgaagtggactcgaatttggtgggttcggccggtatgcaggaccacatcaaccaatgtccgatcctcgtacgcctggtcaacccagtattccgtttgtgccggcttgccatcagcggtaatccgttgaccgtatccggtggggtctttagcaatcggccggtcgatgaaaccgtgtttctgcaatccaacccctgccaccacagcctgatactgcttgtggagcgttttggccgccaacatctcattggctaagctgttggccagccgatgcttggcaattaacaccaggccgctggtaaatcgatccagccgcgtaataatatgggggaccaagtcttcggcgccattctcaaccaggtggcccttgactcgattcaccagggtatcatcgcggttcgccggtcccggcaccaccgttaggccagccggtttatcgacaatcagccagttgtcgtcttcatagataactgaaattggttgcctgctgacggcaacgtttggatcgcttgcctcagcaggaaaatcaaccgttacctgatcaccggctcgcagaacaactgttgcatcaacttttcgcccacctactcgaaattgaccaccatcagttttagcgctcttgtacatccggtggctgatgcccttggtattcaaaaattttttcaacgattgtgggtcattgtctgtcactgtccaagaaaatttcaaaatggcctccaaaaaaatatttttatattgtgtacaactattttgtttacgttataaatcccgccctaacagcaatcccagcatgtgaaccacattgcataacagaaaaaggcttttgtcaaggtcttgacatcgcttgcgcaacttgtaatatgtaagtacaagcaaacccttgtgaatcttttataaaacgaaggagaagttaatatgaaagttgcagttattggttgtactcacgcaggaacctttgccatcaaaacaattttagcagaacacccagacgcagaggtcaccgtttacgaaaagaatgataacatttcgtttctttcatgcggaatcgctttatatctcgggggacatgtaaaggatccgcaaggcttgttctattctagcccagacgaacttaaaaaactaggcgccagcgttaagatgaatcacgaagttaccaacgttgaccccgcctccaaaaccattgaagtaaccgaccttaaaaatgatcaatcatttgaagacacttacgacaaattagttgtcactaccggttcatggccagttattccaccaatcaaaggcgttgacaacaaaaatgtttacctttgcaagaactggaatcacgccaaagaactctttgaaactgcacccgaaaagaaacgcattaccatcgttggtgccggctacatcggtgccgaattagccgaagcttacaacaccaaaggacatgaagtaaccttactggatggtgccgaccgcatcatgagcaagtattttgacaaagaattcaccgacgttgttgaaaaagacttcaccgaccacggcgtcacccttggcttggatcagcaagtcacagaaatttccggtgacgacaccgttaccatcaaaactaccaaaggaacttacgaaaccgatttagttgttctctgcgtcggcttccgtcccaacactggtctattcaaaggcaagttggcaatgaccgacaacggtgcgttgattaccaacgaatacatgcagacttcagatcctgatatttacggtgccggcgatagtgttgccgttcactacaacccaactcacggcttggcctatattccactggcaaccaatgccgttcgtcaaggaatcttagtcggcaagaacattgaaaagccaacagttaagtacatgggaacccaatcttcatcaggtctgaagttatacgacaagaccatcgtttccaccggcttgaccatggctgcggcaaaggcacaaaatatcaacgccagcgaggtgatcatcaccgataactaccggccagagttcatgccaaccactgaacctgttttgatgtcattggtttatgatccagaaacccgtcgaattcttggtggttcattactaagtacctacgatgtttcccaatcagctaataccctgtcggtatgtatccaaaatgaaaacacgatcgacgatttggcaatggttgatatgctgttccaaccacaatttgaccgcccattcaattacttgaacattttggcacaagccgcccaagagcaagctgccaagcttaccaaggccacttcaaaataacggttacattttagctttgtaaataagtctgaaccacgttataatatttactgcatggtgatgacgatctttctaaaccacatttagcgtctcacaaatgcatcccgtctgacttcggtcgggcgggttttcttatatcatgcttgtgctatcaataattcaggctatacttatggcagattcagacaggaaattggaggtatgaataatggcagaagaccattttatcatttcaacaactgaaaacatccccggaaaagaatacgaagtgatcggtgaagtctttggcttaaccacccagtccaaaaacgtcgttcgaaacatcggtgccggattgaaaaacattgtcggcggcgaaatcaaagattacaccaagatgttagatgaagcccgcaacatttccgttgaccggctaaaacaaaacgccattaaaatgggcgccgacgcggtcgtgatgatgcgctttgattccggatcgattggtgcggatatgcagtcagtcgctgcttatgggactgcggttaagtataagtaatccgccggttttatttggaggcctgaaggtagtgatacctttgggccttttttctgtggatcttttgatggttaaaagcagaaccttttgccctccctcctccagccaaaagcctgactcggctttcgtcgctcttctgttacttagctgaaacgtgcttcgggggacagcaaaaggattttaagcccctccagccaaaagcctgactcggctttcgtcgcttttctgttacttagctgaaacgtgcttcgggggacagcagggagaacctaagtcgcaccacccgaaagcctgactcggctttcgtcgctcttctgctacttagctgaaacgtgcttcgggggacagcgattggattctaagcccctccagccaaaagcctgactcggctttcgtccggaggggcttagaatccaatcgctaaacgtcccccttcgcactctttgtaaaattcacgtaaccaacacgtaaaagtttaaccaacttcaattcaaatcccctctttcacgatactatgaaattgcagaaacaaaatcttaagaattcatggagatgaaattgatgattgttaagttgaaaagttctatctttatctcagccgttgcgctggggattctcggcgtcagttgcgttgctcccagcgcccacgccagcgcccccaaagcacttacggctgaacatccgttaaccggaagtcctgccaaccataacgtaacctttaccgggacgtctgcgctttactccaaaccacccgttggcaaaggtgcccacgttgttgccggcaaggcgactttaaagcaattagcctcgtctaaatcttctgctgacaattttgcggctgatcgtcaggccactgccaaaaatggtgccgtctactacaaagtgacttcctttgacggccaataccatggctggatttacggtggcaaaaaagctggtcagtttagtggcggtctggaacctttctggacgttcaaccaaacgaccccaccggccagtctgggtaaatacaccttcaaaattgccgctcccgggttccaaaacgatggcaaaaccgttacatacaaagcacccatcaacacgacctaccaagctggcaaacagattggcgactccgttagatatgccaataccacgtttaagattgacggcatgggcacccgggctcgcgaaggcgatgtttgggttcacatcagtgcgctgaattctgccgacgccaaagcaaatggctggattctttacaaaggcctgcgtcaagcagaatcccccattccaaataatgccttgcgaatcgacctggttgacagcaatggtagtttgatccgctacatcaattacaccagcgccaacgcccaatacgaccaaccactgggtatcccatacgaaacttcctggacgctcggcaacgacgatctcgccaacattcaagttgccgttcgccaagcactccaagggaccggctacaacctggacacgatttctgccaaccaggccggctttcttgcccaggctaaatttggtcaccgggcctcactgaccgttaagaatgccgatcccattcccggaaacgccatccgcatcaatctggtcaacgatgatactgtcgactacaccccaacaggcgcccaacccggccaattactggggaccagttcaaacggaacgacctcattaaatgatactgatcgaaaggcaatccagtccgccatttccacagccttaaaggattctgggtaccaattgaccgacttgtcagcagatcaaatctcagacttggccaaaaccaagtttggcggggccgtttacctgaaagccaacagctccgatacatcaatcgccgataacgcagttcgcatcaattttgttgacccaagtaacgggaaagtcatcaaatcgattgactatgtcaacaccgatgcggatgatccggccaagaaaggcaccactttaggcactcaaaaatccggcaagtggctgcttggcgatagtgacgttgtcgaaatcaatgccctggccgcctcgtcgttgtccggaaccggttatctgttgaaccaggaacacctttccgatgaccagcagagcactttggccaaagccaagtttggcagttccgtttcgatcaatgtcggcaaggccaacaactcaactcactttaatttatacgctgccagttcttcaggagacagcgccaacgctcaacagctgaccccaaccggattgacgtacgtgaacaacagctgggaatttccagatgtcggcggcagcagtcagccaacttacagccagttaagtgcggctgacattgccggtttgtcagccaccaatctggctaacttcaaacaggcactggcaaaatacagttctgattcgctggcagcgatcaataacagttttaaatcagctgccgagatgcagtacgtcgataatggccaaactgccagtttgaaccaggcagacctggattctgccaaaagcaatttgaagaacagcagttggtcaacgcttcaatcgccaaaatatccggtctttagaaaagacgacaacgggtcgattaacattgcttggcaaaccattacctaccacgccaaatcggtcaaacaaaatgcggatgaccaatccctcagcctgacctacacattcgacgcgcaataatcatttatttagaaaaggacgagataagatgaataaacctttaagaacgatcttcacgtttgccttggcatttaccgccgcgggtgttctcgcagcctcgaccaacgcccaagccgacatcatcgacgttcccggtgcggtcaaatcaattccccaagtcaacgccggcaatgtcctcaccaactatgattcaagtgatctgaaaaatattgataacacttcgccgatcgggaacatggatcgcaaatataaccagggcaccatcgatccaactcaggacaacgccggcgacacctttgcgaccactgacgcgacgacaacgaccgctaattcgtttaaaactcagtggttcctccccgacggtttcaatgtaaccgactaccaacacggtaacttccaaagcgtcgcactggacgactctgggaacgtgtactttgtcgaatctaacggcagtgataccaacttgggcgtgatcatcaaatttgataccaataagctcaaacaactggggctggaaaatgacccaatggccctatggaacgcctttaactacttcaatccgtatactgaagacggcgtcacccacaacaaccagtacgatgatctgtatgagtcgatgaaagatacctttaaaactgtcaagtcacttaccagcaaggaagccaccgttaaggcagcaatgaatgacctggcaaacgccaagcggacgacccaggcgaaatatcgaaaggccagcagcacgactaagaagcatttagccgcgagtctaaaagcaaatgccaaaaagatggccgctgacaggaccaaattaaccgcgttgcaaaaacaaattgcgcacggccagtcacagatcgccaaaatcaaggcgaaaaatcctgaattattcaagaacattgaaattgccgaaaccgctcagctcagtccacaagtcgatattggccacggccaaacattgaccttcaacccacaaaacaagcatttgtacctggttgaagataatacgttgaccgatctgcgcaaccgggatgaaaacaacaccgtcctggaaatggatcccaataccatggagccgatcagacaatacaatttcaaaatgttccagggaaccaaaggcaacctccagctgcacacgttagtctttgataagaacggtaacgcttattggggtcgaaagaacggcatgggctacatgttcttctatggtcgactcgacgaaaacagtgtcaaattcgccgctgcccctgaaaaattaaagacccgcggtggctcgcctaatcaaggggtcgctttcaacaatgtcaataatcgcatttatgtggtttctgacgatgtcttgacctccgttccggttgataaactgactgcaggcaccgcaaccccggatgacgtcaactactcggttttccaatccaaacgtgaatgggaatgcctggcatttgactcccaaggctacggccaccttctcgctctgtggccggcggaattgatgaagagtaccgcaccactaaactaaatttgaatggcacctaaaaagcctgcaactcagtatgatgctgaagttacaggcttttcctgtgccttgaacgtttaatgagtgcataaatcaaccacaaaggtccgaaaagcacaatgagaagattcaaacacaaatttttaaaaatgttaaagccaaaatcagccgcgcccttgtatgattgggtctgagtgtagcggaactcccaagggttgacggtgacgccattggccgaccaggcacggttcttatgattggcttgaacgtcagcatgatgcaggcggagggctttgtctttataggtttcaaattcaaccgattcttggctgaatgcctgccgcatcaggattcgaaccaccggcagaatcaggagcatatctaacaaaaagtaccaatcccaagcagacaggttaaatgccaaccgcagactgcctttggtggaccactcaggaagctgcagcgcaccatcataaaaataaatcagtaacagcgcaaccaagccacccaacagagaccacccataattcaagaaatgtctcacgattttcaagttgatccacctctcaacggcaacagaatatcttaaagataaccgttgcgacttgggatgtaaaggcattattaaaattattcacatttatttcacattttagacggattgtgattcagtgaccgcagctacctttgccaaaacggcggcaatttgatcaatcccggctaacagatcagcctcgctcattaccaatggtggcagtaaccgtaacgtattgtgcttagccgacaacgtcagcagcccgttttcttgaagttggccaataacatcctcgactttaacggcagcactcaaatgaatcccgatcatcagacctaatccactcacgctgtccacaacggttaatggcgaaatttgtttgtgaatggccgcaaagaccgcttgagatttttcttgaacctcagccaaaaatgtcggggttaactgttctaagactgcttttgcggaagccaaagcaatcttgttgccgccaaaagtcgtgccgtgagaacccggaccaaacgccttcgccagttcctttttacccagcatcgcaccaattggcaggccattgcccaaggctttggcacacgtaataatgtcaggatcaagatcgtagtgttggaaggcaaacttcattccggttcggccaatgcctgtctgcacctcgtcgatgattaacagaacgccctggtcgtggcatttagcggcaactttttgcagccactcgccattgccgttaacgacgccgccttctccttgaatcacttccaaaatgacagccgccaaatcctcattaatcgcgtcaagtgcctggggatcgttgtaatcagcgaaactgacctctggaaccagtggcttaaatcccgtctggatgtcgggattgccggtcaaggacatcgacccgtaagttcggccgtgaaagccattgttaaacgcgagaactttgcctttaccagttgccttgcgggccaatttaaatgcggcctcattggcttcagtacccgagttacagaaaaaggccagcatgccagctggacacagcgaagcggctacttcatcctgcagactgctggggtacagattggaggtatgccaaactttcccaagctgattaatcacactctgctcgatccaatcattgctgtaaccgaagctgcagaccccgattccgctggtaaaatccaaatacgatttgtgatgactatccactaaatgccaatcatgccccgaaacaatttccatcgggtattgggcatacgttggaaaaacatgttccatattctacactccttaaattgccagctgcttgaccgataaactggtccctgaatgctgcagctgattagtaattttaacttctttcacgccatgctttaatgcgtcaaatgcggctttgatttttggctgcatccctgatttgatgatctcagcctcgaacagttgattggccttctgcaggctcaattgatcaataacgtggctgttgaccatcacaccgggcacatcggttaccagatacagcttttctgcccccagcagtctggcaactgctgcagcagccacgtcaccattgacatttaaattcttacccgacttggtcacggccaacggggcgcacacgccaattccatcggccaaggcgtggtcgatgtaatcccgattgatgccggtaacctcgccaacctcaccataaactgcctgatccaggtagtcaccaaccagtacaggctgaccgccggcatttaatccgacgaccggaagtccatgagcagacaactggcgacagagtgccggctgaaccagtcccaataatacagcttgggtgactttgagggtttgggagctggtaacccggacgccgttaatcttggcgaccggcaaattgagttgggcgctccactcagagatttgtggcccaccgccatggacaatcagaatctgtttgcccatttggcgccagctccgtagctgttcaaaaaattcttctgtcagctgatcagtggcgtgaccgccaactttgacaacaattatctgactcatttccttcacctcctagcttcgatatgatgcgttgatttgaacatattgataagtgagatcacagccccaagcagttccggtagcttttccggcatgtaggtcgacgtcaatcacgactttgttctgtttaagggttgctgcgactttatcatcatcgatcccggtgcccaagcagttgtgaaccagctgcaggtcattaatggcaacgctgacgccgtttaaatcaacgtgggcggttgtctggccgattgcctgcataattctgccccaattgccgtcttcgccaaagatcatcgctttgaccaggttggagccgacaattgccttggcaacccgttggccctccaaatggttataagcgccagagacattgacttcgactaacttggaagccccttcgccatcaccggcgatctcctgtgccaaatgggtgaggacctgcttaaaagctgccgcaaaggttgggtaatccggatcggctttggttaagggctgattctcagcagcgccgttggccatcacaaccaccatgtcgttggtggacgtgtcgccgtcgacagtaatctgattgaaggtttcatcgactgtcgtgctgagcagctgctggagatctcctccggcaattgctgcatcagttgtcacaaagcccagcatcgtggccatgttgggatgaatcatcccagaccctttacaaaatccggtggtggtcacctcctggccatcaatcaaacatttgacggtcatcgttttgggatgggtgtcggtggtcaagattgctttagtgacgccaacgttttgggtcagcttcaattgggaaatcccggccttaatcttgtccattggcagcggttcgccaatcacgccagtggaggcaatccccaccagttgcggatcgatttgaagtcgatcggcggtcattttctgcatcatcaaggcatcggtttctccttgcgccccgttgcatgaattggcattaccactattcatgaccaccgcttgtaattgatgtgccaagttgatcgtctgtttggtcagcttggttggtgcggcctgaaactggttcgtggtataaaccccggctgcgtttgcgggggtactggaataaagccatcccatatcgtcctggtcgggcttgaacccggcgtgggtcgagtcggcggaaaagcctttcggccaagtgaactgactcacttcaatgagtgtcttacttgtcatctgcattcaaatctctcctcggtttacggcaaaaacgtttgtaggttcaagccgctggtttcttcataatcaaacatctggttaaagttttgaacggcttggccggccgctcctttcagtaaattatcaatcacgctgtcgacgaccaccgtctgagtgaccggattgtagacaaccccaatatcgcagttgttagtcccgactacctgtttgatatcgggtaaatgctcaccggtataatgaacaaatggcttattgccgtaggtggtgtcatatgcctgatcaatttgggcatcgccaacgccgggcttaaccttggcataaatcgtactcatgatgccgcgggtgattggcagcagcgtcgtcataaattggatagcggccacatcatcgttccagcgctgcaattccaacatgatttccggaatgtgctggtgttgattgggtttatatatctgcaggttgtcattagcctgtgtgaaatgagtggcctgggcgggatttttgccggcgccagaggttcccgatttggcatcaacgacaatagactccgggtcaatcaagtcattttgaaccaatggtgccaaacctaataacgttgccgtggcataacagcccggattggcaacgtaggtctgatgagcggccgattcgaaatctgccaggccataatgagcttgccgcattgccggttgtggcgccgctggcttgtgataacagcgttgatactcgctggcatcctccagccttaagtctccagataggtcgatcactggaaagcctgcctgaatgtagggttggctgagctgggcggttaccccggccgacgtcgcgaaaaagaccatttgattgtctgccataattgtttcaggatcgtatggctgcacttgggtgtcatccgtgtaaaaagccgaaaccatttgcgacaatttctcattttcagttaatttatggtcatacaggttaatcccggctacttctggatgccgacgaaggagttgatacaataccattcctgcatatcctgtaatcccgactaaagccacttgcaaaccaatcgcctctcatttttctaaatattcctctaattgaatattaatgaattgaaaacatcttacaacaacatacagattaatgcaatgtttttttggtattattcatatttttatttaaagattgatatttattcattattttgagtatacaggtgtatattgggcttgtgaaggaaatttattcacatcagtattcatgaataatattgtcgttttattcatatcgaggttctttttgcttagactgccgtggtgctcagttcgtcggctctgcctaccatagtggcctggatttcgagcctgtagtctcgaaatgccagggtgttgtaatcgccgctttcagcgactcaacaacacctttcactatggtagtcaatgccaacgaactgagcgccacttctttggaacgctgatggaacccccgttacgagttaacatccacatggtttgaaatatccctcacctggcagcttgtaaccctcatttggcagatggtagaaaaattagattcgaatagtcgaaacccttggaaggtcttggagacttgcaaaccaatatagcttgagaactgcatgaaccaaacatcagtcattttgccttctcggttgcctgattttgccggctgggcattgccagccatagtgaaagtgctgttgagtcgctgaaagcggcgattacagcacctttgtatttcaagactacaggcttgaaatcaaagccactatggcaggcggagcccagctggcaaaatcacaaacgttaagttaaattcccccacagtttgaccaactgagtcgacaatcatccacaaaacaaaaggactaaccacatagtgcagttaatccttcgtcaaactaattcaattcaaggtttcggtgccccaactgtttcctgaacgtcttccggaattttatccaaagcctgactgagatcggcaatcaggtcatcagcattttcgacacccaccgacactctgattaggtcgggcgtaatcccagcctcacgcaattcttcttcattcaactgcgcatgcgtcgtcggagctggatggataattaatgatttggcatcggcgacattggccagtaatgagaataacttgaggttttgaataagctgcttgccagctttttcaccgcccttcaaaccaagggtgaagattgagccgaccccctttggaaaatacttttcagccaaatcatggtacttactgtcttcaagtcccggataattgatccaggccaccttgggatggcgatccaagaagttgacaattttcttggtgttttcaacgtgacgttcaactcgtaatgaaagtgactccagcccctgaagtaataggaacgaattgaacggactaatcgtggcccccagatcccgcaaagattctgctctgactttggttgtgaacgcactaccaccgagatcggcaaataccaggccattatattgagcattcggttcggtgaagccgggataacggccgctttctttccagtcaaatttgccaccttccacaatcacgccacccattgtggtcccgtggccgccaatgaatttggtggccgaatggacaaccacatcagcgccgtgatccaatggtcgaaccaggtatggggtgccaaacgtgttatcaacaatcaagataatgccatgtttgtgagcaatctttgcaacggcttcgaaatcaatcaaattaattcccggattcccaatactttcgatatagagtgcttttgtgtgctcattaatcggtgcttcaaaattggccggatcgtccgggtccacgaaatgggtcttaatgcctaatttcggtaaagtgacgttgaagaggttaaaggttccgccatacaacgtgctggccgagacaatttcgtcacccttgccggcaacattcaaaatggcggcggtgatggctgccgaaccggttgccagggtgacgccgccggtaccgttttctagagcagcgacccgcttgtcgacaacatcggtggttgggttggtcagacgcgtatagatgttgccggggtccgtcaagccaaatcggccggcggcctgctctggattgtcgaatacgtacgaggtggtttgataaattgggactgctcgagaaccggtttcatcaaccgtttgacccgcatgtacctgaagtgtttcaaagtgtaagtgactgttttcttctgtcatattgataaacccactttcttatttgcgatgattttcgtccagttatcataaatctgaatactgctgtttttccaagaatagtccaccgttccggaatcctgatcaatgaagtagttttgcggcaatctgatcggcatctgctcatataaatcgcggtaatattccaataccagcgttccttcggaatactcgggatgaccggtgatgtaagtgctgtgaagactgtcagctgacaagatgatcgggccggtaacagctgatgaaacatccaccatcaaaccttccggaagatgatcctcgtccaaaacaatgccggtatgtctggattggggcatcttcagcaatcccccagcgccaaatccacgggcaatcggtgattccgcgttgatggtttctgccggataaacaccaaacaatttgctcagcagcaagtgtttccgaacaccaaagtcgtggaacaaacaggcttgagcagcccaacattcatacaaacattcagtgacatgatcctttgaccagtcaatgatttcctcaagctcatcccaataatcaacttggttgaacgggagcgtttcgattggcgctccagtgacaattaagccatcataatgggcatccctaatttgatccaaacagacataatcccgttgaatcaggtctgttgacgtcccacgaaaatgatgggatgacggatacataaacgttaattccgcgtcggaaccaatttcactgaaccgcgttaaaaactgacgctcagtattctgccgtgttggcattaggttcaacaccaagattgatagcggattagtaacttcgtggttaacccacttttgtgctgccaataagaacccattaattgcatttgccgtcatccaaatcatctccttaagtcataaaaaaagcttccgtccacatagttatttcaactacgggacgaaagcttcgcgatgccaccctgatttactgtcacctcacaatgacagccttaataagtactccttggaatacccggtccaatatcgcggactcgcggatatcctagccttttgaccggatacctgactcagagctcatcttcacgtcgctgcaaaccacttctctcaccaaacgaagctctctttaggaatgcgttaacgttactcttctcttcaatgtctaatgtatttttaataattgctaataactttatcatcacaacatgcccttgtcaacacccatttgaaaaatctttttgtcatgattaaaaacatatgagtttataatggaatgcaaagagatttttcaaggggtgaaagtatggatcaatcaatatctgaagatgagctgatcgccgtctgcggcaaggtcggtaaaattctgctcaccagcggtgcggaaacatcgcgtgtcgaaggcaccgttgaatatatcggccgcgctgcccattatgatatcagctgccacgcgacgattaccgccctgtttgtcggggtcaaaaatcagaccaaaacccacttggttaaagtccgcctgggggatttcaacttggaaaaggttgacgaaatcaacaccatgtcacggaaatttgtgaccggacagattgattttgccgagctcaaacgaaccatcgaccaaatcgacaagaaagtgattgactttacttggccggaaaaagtgtttggtgccgccatggtgtctgtcgcaccaatgctgctgttcaaggcaacttgggccgatctttcactagcgtttttcgtcggcatctttggctacttggcagcggccctttccagcccccggatcaagaccccttatgtggcagctggattaggcggttttacagtcggctttttggcagccgtcctgcagtccctgggaatcgccactaacgccgggaacatcattgtcagtgctttaatgccactggttccaggagtggccattaccaactcgtttcgagaaatcatcgatcggaatactatttccggagttgtccgggcggttgacgccttgattatcgctggatccatcggtgccggagttgttttgggcgttgggctgtccggaatcattttccatctgattggaggcggcctatgaaagtcctgattgaactcatcgtcagtttcgcctcaacggtcggcttcggattggttaccaacgtcccccggagatcactgttacccgccggcatcaccggatcactggcctgggtggcctattatttagtcttgcaagtcgataacgggttaattctccccaacttcaccgcggcaattgttatcggcattctgggtaatatttctgcggtgatgtttagagtccccgtcaatattatttatgtccccagcttggtttcattagtcccgggcggcattttatacctggggatgcgcagcttcactttggggaatgaaatccgcaccgggcaatacatgttcaatgcgctgacaattgccattgccttggcagtcgggttcgtcgtggcagaagttattttttatcgaattaaaccgcttttgctgcgacttttggcaaagcagcgtgaacgataaggtgaccgccctcattaatcataaggaatccaaatcaagcagacgtccagttgaatcttgggcgcctttttgagtgttgttgtttcgaaaatcagttcaaaatgatagcgtttccgtcataatggttctaaataaaatgttatcatgataacttttgaatgatggtcggcggtgggcattatctacctgtgtattcaccttttaaacaataatccgcattttatggcaaaagaatcaatatgtagtttataattattctaatttattcgacaaatcacctcataaatatgttacgctgtatttagcaagtcaaatacttgtaaatatcgaatctagaaaggcggaatcgttgatgaaagttattgttgttggttcatctcacggtgggtttgaaactgtcagggggattttggcagaaaagccggataccgaaattcaatggtatgaaaagggcgacttcatttcatttctctcctgtgggatgcagctttatcttgaaggggtcgtcaaggatgtcaacgctgttcgttatgcaacgccggaacaaatgcgggcccaaggtgtcaatgtgtttgtccaccaagaagttacctcaattaatccagacgagcatacggtagttgtccataatttggacgatgattcaactcgtgaagaaaaatatgacaagttggtactatctgccggtgccgtaccggcaagaattcctgttcctggcggcgatctcaaaaatgtctatgcaatgcgtggacgtgactgggccatcaaattaaaggagaagacggttgaccccgatgttcaaaatgtcaccgtcgtcggtgccggctatatcggtattgaagccgctgaagtcttttccaaagccggcaagcatgtgacgttgattgatattctccctcgtccattggccctgtacctggatcaggagtttaccgatgtcctttccaagacgctaaaggatcacaacatttacttggcaaccggccaaacagtcaagtcattcaatggtgaggacggccaggtgacggcagttaagactgatcaagctgaatatccaagtgacctggtcatcgagactgccggcatcaagccaaataccgactggttaaagggcacccttgatttaaccgataagggtctggtcaaagtcaatgatcatcaagaaaccagccagcctgatatttacgccgtcggtgacagcaccaaagttccatttgccccaactggtaaggaactccagattgctttggctaccaatgctcgacgccaaggcaggattgctgcgaaaaacgtcctgggagacgacatgaagatgccggctgtttccggttcatctgccctgtctgtctttgattaccactttgcttcaacgggaatcaaggaagggacttccgcagccaacggcgtgttgagtcaatccgtcttcgtaactgataccacccagccaccattcgtaccaaatgaggccggcaatcaaaaggtctacttcaagttgacctttgatcccggaaatcaccggattttgggtgctcagattatgtcgaagcgtgacgtcaccgccaacatgaatgccattagtttggccgtccaagcaaaaatgacgttggatgatttagcctatgccgacttcttcttccaaccaggatttgaccggccgtggaatatcatgaatgtagctgctcaaaaagcactccaaactttagccaaataatcagttaaacaaaattcctccctaaaacgattgctcaccgttacgcaaacgcaaatctgcgttatagtaaaggcgtagctaaaatcattttagggaggaatttttttgaaaactgtcttaattcttggtgctgccggacaaattcccagtttcttaatcccccagctcttaaaacaaactgattttaatttaaaactttacgctcggaatgccaccagtcggcttcacgtaacggatcccaagcgcgaaacagtcattgatggtgactttaacgatcacgatactttgaacaaggccatggatggtgtcgacgctgtctatctcaatgagatgcgggacatcacgtccgttaagaacatcattgaggcaatggatgccaaccacgttcgccagttcattggggcgaccgttctcgggatcgaagacgaagtcaaaggtgcctttggtcagtggaataccagcatgattgaaagctcgatcaccaagcgcaaaaccactgccaaagcgatcgaagattctgatctgacatataccctcttgcgattggcatggctgtacaacaaggatggcaataccaattacgaattgactgaaagcggtgaaccgtttggtggtacggaagtcactcgtcaggcggtggcccagttaatcatcgacatcttaaacgacaactcacggaaatttactcgcaagagtatcggtgtcaatgaaccgaacaccaagttcgataagccgtcattttattgattcaatttcggtgactttgattaccactgttatattgataaaatgtgcagagtttaaacaaaggagcgagtcattccaagacaggaatgactcgctcctttgcttaaatgatgggtcaaaacgcattacgttccacactcataaatttccatcatcaattaatgaaaaattttcttcgcaatgtcaaacgcagaccaagcctttggccagccggcataaaatgctaaatgagtgatgatctcgacgatttcgtcttttgtaaccccgtttgccttggccattttcatatgggcttccagttgtgggaacaacccctgtgacatcaagctggcacaggtgatcatgctgcggtccctggcagacagctttgattctcttgaccagacttcgccaaataaaacgtcgtcatttagttcggcaaatttgggtgcaaaatcacccagtgcatctcttccagcagtttgttttttagccatgattattgaacctccaattgatcgtattcttcatctgagaccggttcgagccactccggtgtcccagcggtaatcgcaatgtgtgagaaccaactgtcttttgtggccccatgccagtgcttgacgccatcgtgagtcacgaccacatctcccggaactaagtgttgagcgggcttgccggcctcttgataccagccttcgccaccggtgaccaacaaaatttgataaccatcgtggtgaatatgccaattattgcgacaaccgggttcaaaagtgacgttgccaacctccacatcaaccgctggatcattgactaatccctgaagataactctgacccacaaaatacttggcataagcatcgtttttcgggccagctgggaaaatcacaccatttttaacattttcatttttaaccattttatttcctcctcatccaaaacatttactttacaaataggagcatacaacttaaagttaactttaagtcaaacacttcttaaaaaataatggaggaaatatcatgccagctattcaatcagaaaccagttatgaaatcggcgaatttgccgaaattgtcggcctctccgctccaaccatccgctactatgaaaatcaggggctactcaaagcccgtcggacagacaacggtcgccgatattttaccgaacaggacatcaagtgggtcaaattcctcttgcatcttaaaggcaccggaatgagcatcaacgacctgaaaaaatacgtcacttggcgggctgagggcgaccagaccatccctgaccgcctggatttactcaagaaaaccaaggccgatttcatggaagaataccgccaagtccagcatcatctgcagattctaaatgataaaattgactggtatgaagccaaagaatccggcaaagataccggtaaggaaccctttgccacctacttgcagcgactggggcaccatgaataagtttctgagaatttcacagaaacttgtcagggactaccactttcaaatgagctgccagtcactctacaatgttcatgattattcaattgaaccagaattgaggggaaattatgacgaataccatcctgctggttgaagacgaggaagcactcagctcgtatttaatcccagaattaaaatttgaagattatcaggtattgttggcaaaagacggtcttgaagccctccaagtctatgacaataaccgaggcaacttagatctgatcattctggattggatgctgccaaagcttgacggactggaagttctacggcgaatccgcaaaaatgatgacatcccagtcatcatgatgaccgccagagattacgtcggcgataaagtcgctggactcgacagcggtgccgatgattacattaccaaaccatttgaaatcgaagaactgctggcccgaattcgagtcgttctccgccacgagagtcatcaccaccagcaaagcgaactgtataccgtagaggacctgaccttaaacaccaagtcccgccaggtttcgcggggaaatcaactgattcaactcacccaacgggagtacgaattgttattaaccctcattcgccacggcggcgaaaccctcacccgtgatgagctgcttgacgcagtttggggggtcgacttcgaaggccagccaaatgtcgttgacgtttatatccgctacttgcgcaacaaagttgatcggggatattccaaacagctgatccacacggtccgtggagtcggctatgtgatgtccggaaattatcaggaataaggagtcttagtttggcaaagaaacagcatcgcaccacctatcaggcaatccgtcaccactttattatcctgctaaccttttttgccctatttaccggtatcgccgttgtcttggtggtgggcgtgaatttggtccgccaaagcgaaagccaatcggtagaattactcagaagccttaatcgctcattcattgacgacaaaccggattggaaacagtggcggaaaaacagcagcatcaatactgaaaatacttatgtcagggtaacggatcaggttcatacggctaaacagccggaactattttattcccaaggagcacctcaatttttggcggcagcaccaaccccgatttcaaaaatgatccacatacctgttttcccggctctcatttatgccaagggctatggcctcttctattatcgcagcggtgttcggcatggtagtcaaaagaatatccgctcagaaatttggctgagcctcaatccaatcgttcaactgttaacatcggtcattttaatcgttctgttggtttcacttgccagtctgtcactgggctggttcgtcatttccctgattgcccgccagttaacggagccgctgcaaaccctccaggaagccgccaaggctcatagccaatcgattaatcgggttgaaacccttctaccggttccggagtccccaatcgaggccaaacagcttgcgattagctttaacgatttgttatcagccatcatcaaaaataaccaaaaagaaaaagcatttatttccaatgcatctcatgaattgcgaacaccgattgcagctatccggggtcatattgcccttgttaaacgccgcggcaaagcgcatcctgaaattatcgacagctcacttcattttattgacgacgagtcagcaaaaatgcaggcgctggtgaacagtctgctggccctgtcgcgagccgacaaggaagtcgtcaccaaaagtcattttgatttagcagccatcgtcaacgaaaccgtcgaagaacagcgggtgcttttagagcaaccaattcaagttgtgggcgagcaatcagcaatcgttcatgccaaccagaccaatattacccagattttatctgcccttttagataatgccggcaaatattccccgccggatgcccaaatcacggtcaaaatcagcaaacgtgaccatcaaacaattttggctgtcgaaaacaatggcccaagcatccccgaggctgaccaggcccatatctttgatcgtttttaccgcggggatcctgcccacaacagtcacattaccggcaacggattaggcttagcaattgccagtcagcttgcccagctaaatgatgtcggcttgcgggtcacaaatatcttgccccacggcgtctcgtttgaagtcagctttcccgacctcgatttaacaaaatagcaccatcaattgccttgcgttcttcttaactgacacttacatccccactttgagaccttctgagaatttatcagaaggctctttttttagccctgtatttcttcgccaaaaatcacagtattcttggcttgtaagttcgataaccaagtgattggaggaatattcatgcagacatcaacaatcaaaaatcatccgctgctgttcttcggctggctgatctttattggcatcacaggattggtcctcctgcaaaatgttcagttgtatttttgggaccgcgattttcttaactatctccagcgatttattaccccagacagaacaagttttttcaaaggagttgccctgttcggcagcccaatgataacagttgggttggcgattatcgccagtgtgtttctttggcagcgaaaaatgctggaggaggctctgacaaccctggtggtagtcgttaccggcaatgcgggtggcttaatcattaagcatctaactgaacgtccacgaccaaccaccatgctagcccatgactcaggctacagcttcccaagcggccatgtcgtcagtgccgttattctgctgttaattgtttttcaattcatcctcccgctcatctcatcggtgaggttgagaatgtttttcagcatgatgttagtcttctgggtagccctgatttgcctctcgcgactctacctacaggttcactatccaactgatgtgattggtgcggcgctgtatggactgctgtggtgggaatcagcaatggcagtccttcaccgccagcaattaaatacccaaaaagttatccaacacaatcgggggcagtcatcatgaaccttaaatatacaaccagaaatatcctgttaatcgtcgctttatcggcagccctgaccggcgtggtgttggtgatgatcttcacagttaaccaaatcaccccatttgggactcacaatctattagttggtgatatgagtgcccaatacgtcccatttctgaccggctttcgaaacgccctcttaaccggacacttctcattattttctttttcgcttggcgtcggtgaaaacatctttccgctcatcacgtactatctattgagtccatttaacttactggtcctcctatttccaacgagccagctgccggtggccatttcctggatttttatcctcaaagacatgacgattgccgcgacgacctgctggtttctcgctcggcatttcaatcgaattcatcttttactgccatttttcgctctagctttcagcctttgcggttttgcttcggcaaacttcgtcaatatcatgtggctggacggcctcatttatttgccgttaatctgtgacggaatcgatcagatcaaagcgggaaaacaatcgatcagtttatttgtctggctgacggcagcgatcgtgtccaactactatatcggctatatgctcggactgtttaccctcatctacgcagtcgaaacgattatccgaaccaacgatcttcacttctctttgatcaccgccatcagccacaatcgacagtttattaccagattcattttcaccgaagccgccagtgtcatgtccagtatggtggtgctattgccgaccatgttgggcatgcttcagaccgccaagaccagcccgtcaaccaccaatagtctggctgcggcagccaagccacaatttggtttggagatcttttcccaattgggtttgggcgggcaaacgtacgataatcggctgctacatgctccggcgattttttcgtccttagcgatcgcccttttagtgatcggctactttttccatccccaaatccctcgaaaccacaaactagcggtctcggtaacggctggaattctctcactcagtatgctgattggaccgatcaatctggtttggcacatgctcaatgaaccgtccggctctccatttcgctattcattcttgctgagttttgtcttgatctccgcggcttacgaaatgctgttggccaccccccaacgcttgtcattcaaggctaaattgagcactccaacaattctagcgggattgttaattgtcggttatctcgacatccgcctgggacgccatgtgctcacaaacgactatttggccgttcagcccaactcactcaacgtcctcatagtcaatctccttttaacggtcatcttctcatacctcctgttcacagccgtccatccgatgcagcaattattaattggaacaattgtctgcctggaaatgggtaccaacttcggctacaccctcaagagcgaaccgctgcctttgcaaacaagctacgagactgcctatcctcgagttgataccatcgtttcaaagactaaaaccaccgacaatcagctataccgcattgaccagtctcacagtcagttggctcccatattcaaagaaacttacttaggctataacgatcccatattgttcaattacaacggcattcaagaatacagctcgacgttaaccgaatccacccgtcaatcactgaaaatgatcggtctgttcagtaagaatcagcgccgaatcagtactgccggctcgactgccatttccgacatgctgttgggggttaaatatcagctgaacccagctggaaaaattgagaaaaacacatcctttgcagggatcggcttcccggttaccaaccaattcgctcatctacaactcaccgccggcacactatttaccaatctggaaaggattctccaacgactgacaccttccgaccaaccgtatttagtaagcgaatctggaaccaacccacaacggcaaacaatcagggctcgcgaaaaatacaccctgacgatcattcccaagctcagcggtccgctgtacttcgatacttcagataaactactggattacagcgccatttatgtcaatcacacccgattgaaaaccatccccaatcaacttgataaacagtacctggttaaattgggaactgccaaacgtggcgtcccggttaccctacagctcacatccaaaagtcaaaacacccttcacgatagtcatttcaacagcctgaatgaatcgcaattcagcaaagttgatcaacacctgaaacaaagcgcttttacccccacctataccaacgatcgtttggtggggacggcagttcgcccaaattcacaatcagaatggctgtatacagcaattccatatgatcccggatggacggcaaccgttaatggccaacccgttgaaccaattaaggtgttgggtaactttaccgcattaccactcactgatcagtcaaaccacatcgtgatgtcttatcacgtccccgggttgttgtttgggatcattctttctcttttaggcttattggcgtttagttggcgccaatttcgcaatcttgcccttcgaaaagacgtgagtcaacaggcgccaggagatggaacaccctcaaacggggaaacttactagtaatactggcaagaaacgttcgatcaacgtaactgctgcgatcctgcctgcctttgaatttcaaatcatgtagaggtatactcatttaacaacataaaaatcaaaggaggcaactacatgatctattcaccattaaatgaatgtgatgttccaactatccgttaatagcgggttattccgctaatcatttcatacgaaatctaaaaagcggaggaacatcatattgaattcaaaaaaaatgctcggtgcattgctgctaagtttagctgccagtatctggggggggcatgtttgtcgtggttaaagtggtggttgagactatcccgccaattgaactggtctggttgcgatacctgattgcgttggtttgtttaatgttatttgcagtcatttttcacattaaatggcgtttcaatcaacgtgatttgggaatcatcattttaatcggtattattggcaatgccatttccatcgtgacccaagaaaccggaacttggctgtcaaacgctcagactggggcggtgattacttcagctacgccgaccttcatgatcatatttgcctggtggttgcttggtgagaaattggatgctgttaagatcatttctgttaccatggccactttaggcgttatctggattgttggcgttcacttctcaggaacccatgtgttactcggaattttttcgttaatcattgccgcattgacttgggcgttgatgtcggtcctggtcaaaaaagtttcaggtacctataactcacttcaaatcacgattatgtcgacttttgtcgcattcgtttgcctcacgccatttgtcttgagccacatggatgtgattacccaagctcattacctggaacccaaaattggtctcagtctcctttatctgggaatcgtctcgacagccttgggctttgttatgtggaataaaggccttcagttaatgaacgctgccagttctggacttttctttctgtttcaaccgattgtaggaacgctacttggatggttggttttaggtgaaaccatttcgtggggatttgtctttggcaccatgatgattatcggcagtgtttgggtatcaattcgattcgctaaataatgacacttaaaaagggaaacgcaaaattgcgtttccctttaatcgtttctaaaaattttattcgcccttagcctggtaaacgtactgacgcgtcattggcagaccggttccacttggggaattggtcaacaagtactgcataacatcaatattaccggcttcaaatgaagcggcactggcttgtaagtacatgccccacattctggagaacggcacaccgtacttttctttgaccttatcgatgaccttcatgtagttggcgtaccagatttccaaggttttttgatagtgacggcgcaacggctccaaatcactcatctgcattccggcatccatgatgtgagtcatgttttcagcgacgtttggaatatagccgccatggaaaatatacttgttcaagaacggatcaacgccggctccctggtgctgaccagtaatcccgtggattaaggctcgtccttcaggtttcaagaaatcatgaactttctggaagtataagccaaggttttccttgccaacgtgttcaaacattccgactgaagtgacgtagttaaattggcctttgacttcccgatagtcttcaagcaaaacgtcaactttaccttcaaggtggcgttctttgatttgttgcttggtgtagtcatattgttcctggctcaaagtaattccggtagcctttaaatcaaagtcttcagcggccatgaacaacaaagtgccccaaccactgccgatgtccaataaagtattaccggcaaccggattgagtttgtgtaaaatatgccggtctttgttcaactgagcttcttccaaagtatcgtcatcgtgttcaaaataggcacatgaataagtcatgctcttatcaagccacattctataaaaatcattaccaatatcataatgcttttgaatgtctgactcactggctttctccgagtgggaaacctttggtaagtgcttcaagaatgggttgttggttaagaagctatggtcggcacgaaaggctgaggcaactagctcttgaatgctgccgtcaatctcaatgtcgccgttcatataggcttctgccaataccagtgttggctgtgaagtcattttctttaatggaatttctttcttaatcgtaatcttaacttgcggctcaccatctccgtagttatcggtcttaccatcccagtaagttacagatactggaatatcaaacgcatggctaagcagctctttataagtgatcttctctaacatgaaatttcctccattgtttttctatcagtaacagtgtaacgcttttaggggtataaaaagcaagcataaattcttttgaatttactttcctgttggaacgactttaaatttagtgccgtcttttttaaccactgcatagaggatcgaatcttgattatcgtccagatagcccaggtcaactgcaggatggccgtcgatttcggtcatcccttcaaatcgatcgaataggacctgtctcgctaatttgagttcgtggcttttggattcggccttttgggcagcgactgccaaagtgtagccctgatccaataaaactttcatctgatagaccttgatcagcatactataggaaaatttgcgattctggccttttccctgggtgctttcgatatagccctttcgttcccagtaccgcaatttggtctgggaaacgccggtggcattcgcaacgtctccgatgcccaagtgccagtcgttctctttcatgatttgagccagcttctgctggaactctttatccaaaatgatccctcgtttctcattttcaaaagttgtaattgcttccattgccttaaaaccggcatttcaattattaaatcgtctgataccagtgagacattaattaacattaagtatatatttttaaatatgtttgtcaacttgcttgacaattatgttgaaacattttatattagtccatgttcgattttgagagaaatcaaaattttaaataaagaaggtcctaaatcgtgggtaacgcagtagataaaaacgggaagtcatacaaccgtggtttgatgattatcgttattctggtcggaacattttgtaccgttctgaatcagacgattctttcaaccgcctttcctaccattatgaaagcattcgacgtcaacacatcgactgttcagtggttgaccactgggttcatgatggttaacggaattatgattcctgttagtgcttggttaagcacaagattcaattctaagtggctttatattagtgccatgaccactttctttgccggaacgatcgtttgttacatcgctcccaactttgcgaccttattaatcggtcgtttgattcaagccctcggtgttggggttaccatgccattacttcagacaattatgctttccatcttcccacctgccaaacgtgggactgccatgggacttgccggaatcgttattggcctggcacctgcaattgggccaaccctttccggatgggtcattgataactggacttggcgtgatctgttcggaatgatcattccattgatgttcttagttattcttgccagtttctggctcgtcagaagtgtattggataccaagaagacgggcatcgacctgctttcaatcgtcatgtctaccatcggatttggaagtttgctttacggcttctcatcagttggtgaagatggttggggcagcacaatcgtgatttcaacgttgatcgtcggcgttgtcttcatcgccttgttcatttggcgtcaattgactatgaagaccccattcctggaatttcgggtctaccgttcagtaccatttaccgtctcagcgattttgagttccgttaccatgatggccatggtcggagtcgaaatggtcattccactttacctgcagattgttaaaggcatgtccgcctttcattccggattaacgttgctggccggcgctttaatgatgggaattatgagcccaattaccggccgggccgttgaccgttttggtgctaaacgcctgtcaatcttaggaatgagcttgttaacattagggtcaattccgtttatcttcattaccaagagcacgtcaactttatacattgttgtcttctacgctattcggatgtttggaatttcaatgacaatgatgcctgctacgactgttggaatgaactcactaccaattaatttgttaagtcacggaactgccgtcaacaacactcagcgacaggttgccgcttcagttggaacggctgtgttgatcagtatcttgaccaacgtgacgaagagcaacaaaccggctcactcaatgctgacaagtaacccgcttggctaccgtgatcacatgatcaacgccacgttaaccggttatcacgccgcatttgccatttcactgctcttctgtatcttagctttgatcactgccttcttcttgaagaaccgtggtcactcaactgattacactaaaaatggaggtgaagactaatgatcgttatcacacttgtaattggggttgttctcgcgtttgtcttcttcatctacatttcaagtaaaccggtcagttatacccttactgcgctctcactattgttggcagtcgtatcaatggtcttcatcattaagaacgaccacgatcattacggcatgaaacaagtgacaacagaaacatcacagcaaatttacccaatcggcagcaagcaaatgcagatgattctctatcagccgattggaacagctaataagcatcaagtttatatttatcaaaaatcagccaatgctaaaaagaagtcccatacgcaaacgactgataccaccaacaaagtggtcatgaccagcggtacgactcacatggtcactcaaactacgcgttgggagtacaagagtgatgctgccaaattgtggttcggcatttctggtgaaggccacaaattcgtcaaacgtcacaacatcttgtatgtcaacaaatcagttcaggttctctccgctcaacaagccaaagcccttaagaaaatgatggcaagcaaatcttaccaagctaaattaaaggcccaaggtaaagcgtttgtcaccaagcaggtgatggccgcaatgaagaagaacccaaccatgtcagctgctgaccgggccaaattggtcaagcaggccaccgctgaattccaagcacaagccattaagaatgtgctggcacagattaaaaaataggttccatttctcttccaatattaaagcgcaccaattcaacaataaccgttgagttggtgcgcttttttagtcaattaatttgttaggacttcggtcaactttgacaggaagaattctaattctgcatgagttcccacggtgactctaatgtgatgcggatacccccagggcgtgcagtcacggacaatcaccccatttttcatgagggcgttgacaacgcttattgcatcgggtgcgccatcgggaagttgggcaaacacaaaattagcttgggacggggcaactttgaagcccagaagtcccaacgactcaaccagtccttcacgatcaccgagaatttttttgcgcgccttattagattcggtttgatcaaattgaagcgcagcacttgcgccggcgatcgccgttcggttggtgttgaacggttctgtcacagtatcataagcctgaattgcctcaggatcacccagcacataacccagtcgggcacctgccaggccatagaatttggaaaaagtccggatgaccatgacccgtttattgccaatatagcgaagaaagttcgccaagctcaagtgatcggcaaattgggcataagcttcatcaacaatcacccagacattatcaggtaactgatccataaaagcctcaagtttggctgcatcggtcaacgtcccggttggattgttgggattacagatccaaatcagcttcgttttgtcggtgatcttttgctggaattcgtccagatcgaactggtaatcatcggtcaatgggatttcaatgaccttggcgcccattaatcgagacacttcccggtacaaccggtacgactgtttggcaatcagcacctcgtcaccggcattaataaacatcttggctaccgtttcgataatgttgccggcaccactacccaaagccacattctctggttttaagccattttcatccgccaatagctgaatcaaattgacaaagtcatcttccggataccgattcagcgtactaatacttctaatcattgcattcttggagtggtagtacggcgcatagggattctcattagagcccaacttgaccactttatccaaatgatactttcgagcgacctcatcctctgtttcaccttgaatgtatggttgagtcacattgacttcatttcgaaatgttgcatcaaattttgccatcatttcaccgccttaatcacaaattaaatatctttataagtccatcctaccgcgaattggttctggattgtgaattcttgccctttaatttgcattaaaaaagaggccgggacataaatggtaaagatggctgtcattgcaactttgattaccacttgtatatggataaaacttgtaacaatcggctgatcccggccatttaacgcataaagccagtcattccaaaatccggaataattggctttatacgttaaattctgggatcaaatcgcctttcgtcccaatctcttgaaaatcattgatcaattgtgactgattccatcacaacgtcttcattaggcttgtcttgagcatttttctcaacctggctaatctctttaaccacgtccatgccagagataacctgaccaaaaacagtgtgtctgaagtccagccaaggcgttccgccattcttgtaggcttcaataatttgttcaggataaccggccgtcttcatttgagaaatcatcccgtcatcaacatgttcgttggaaacaatgaagaactggctgccattggtatcagggccggcgttggccatcgacaatgcgccgttaatgttgaataactcaggtgaaaattcgtcggcaaaattgccaccaaagctgctctcaccacccatgccggttccagttgggtcgccgccttggatcatgaattcaggaatgacccggtgaaaaataacgccgttgtaataacctttttctgctaaggcaacgaagttttcaacggtctttggggcttgttcagggaacaattgaaccacaatatcaccgtgattggttttaatggtggctttgggtcccttggcattctttaaatctaattgaggtaacgtcatgatatatctcctttagttaacaaaatctatcttaaatgagcttatcacacccagttcataaagtcaggaacttcgacggtatttcccccgttttaaccccaattacggtaaaatatggataaagtttactttataaaataacggggtatttgtgatgagggttaatcaagcgcactggcggcgaaatatttatttgttcttgacgagtcaatttttgactgggattaccagcatgatcgttcagtatgccatcatttggtatctaaccaaagaaaccggctcggccaccatcctcagcatcgcgacaattttgggcatgctgccgatggcactgctcagtccatttgtcggaccactggtcgatcgctggaacaagaaggccttactcatcgttccagacgtggtggccgcaatctttgcaattatcctgtcggtttccggcggggtctttcacgtctttccaatctggctgatttttgtgtcgctattaatgcggtccattgctcagacttttcaaatgccgacgattcaatcggtgatgccaacgatggttcccgataaggaattgacaaagctcaacggtcaactcggcatggtccaatcagccaatatgattattgcgccggctctcggtgccttcctatttgcgattatccccctgcaatatctgattttgctggacgtgcttggcgccatcctgggtatcagtatcttgatttgggtccagattcccaacaacgaaaagatcgacgctgctctgcatatgctgcacaacaccaagcttggcgttcaagaactcatgcacaataaggggctctggtacattaccatcaccggagcagtcttcaccctgctgtacatgccggcggccagcatgtatccgctaatgacaatgaaatatttccagggaaccgttggccaagctggctttatcgaagctttgtactccggtgggatgctggttggcggggccatcatcggtatctggggcaactggtccgacagaatgaaaccagtgatcattgcattcttccttgtcggcatccctaccggtttaagtggcctgcttcccggtaaccagaccgggtttatgtggtttgccattttaaatgtcgtcgaaggaattgccacaccgtttttcaacacgctcttgatggcgatgattcagcagagttacccgcctcagcaactgggacgagtcctgggggtactaaattccctaatgagtttaaccgggccaatcggactgattttcgccggcccccttgccgatgcattgggagttgagatgctctttgtcatcgccgggattggcacggtcatttgtgggatttttgccttgatgatcccaatcatgcgagaatatgatttaaaacttcaagcccgactcgccaaagaagattaattttaaattggtagttgccttaaagtggacttcaaggtctacaatgactttgtaaataaatgtaaggggagattatttgatgaaatcaacattatttgtaaaaccaggaaaagttgaaattgaagagattgacaagccaaccatccaagctgatgacgacgttattttacacattgtccgtgcctgcgtctgtggatctgatttgtgggcttaccgtggcttggaagataaggaacccaattccgaaaacagcggccacgaagcaattgcgatcgttgatcaagtcggcaaagacattactaccgttcagcccggcgactttgtgattgccccatttacccatggatgtggacactgtgctgcctgccgtgccggttatgaaggcagctgccaaactcatagcgataacttcagttccggctaccaagccgaatatgtgcgttaccagcacgctgaatggtcactggtcaagatccctgggaaaccagccgattacagcgatggcatgttgaactcgctgttgtcgttggctgacgttatggcaaccggctatcatgctgcccgggttgccaacgtcaaagctggtgacacagttgtcgttgtcggtgacggtgccgttggcctgtgtggcgtgattgcttctcaaatgcggggtgccagccggatcatcgcaatgagccgccatgaagatcgtcaaaaattggctactgaatttggtgcaactgatattgtccctgaacgaggcgacgaagcagttgccaaagtcatggcattaaccaacggtgccggcgcggatgccgtactggaatgtgttggctctgagctttcaaccgaaactgccatgaaggttgctcgtccaggcgcaatcgttggccgagttggtctgccgcataccaagaagactgacctcagcagttcgttctatggcaaccttggcattgccggaggtccagcttcagtaaccacctacgataaatcagtcctgttgaaggctgtcttagacggtgacattcacccaggcaaggtcttcaccaagcgcttcaatctggatgaaattgacgatgcttatcaagcaatggctaaacgtgaagctattaagtcgctggttgttgttcaagattaataagagtgtgaaagaggacgtttagcaattgaaatttaagcccctccagacggaaaccgagtcaggttttcgggtggaggggcttaaaatttggttgctgtcctcttgaacacatttaatccaaataacagtaagacaccaagaaaccgagtcaggttttcggctggtggcgcttaaatttcaattgctgccctctttcacacatttcaactagatatcaatagaacccaagagaggccaggacacaactaacaatcagttgtgtcccggcctctagtcttttggctgattattctcttttccgcttcttaccaaatccaagccaaccaaacattgccaataagatcatgccaatgattgaaaccgcttggccagtttcggtatcaccagtttgtggtaaggctgcttgtcggccttcgttagttcctttctctgtagctgcttggccaacagcttgggttgttgcttgcttagcttggccagcttgagcatcgttagcaaccactttgccaggatcattgaccttcaattgttctttgctattttgagggtcttttgcggtttgcttcttcggtgcttcaggtgccttttcgccagtcttgatcattcccggttcctgagactcggtcgtgtcttcatgaacaacattctcctgcggtgtcggatttgtctcatttggcgtaccaggtgtattcggtgttggcgtcggagttcccggagttggcgtgcttggtgttggagtgatcggcttgttaggatccacgttgccaccaggcgttaccggattctcagccttcttcggtgccactggggcaaccggttcttgtggctggtcaaggtttggctggtagtctgccacgactgtcgttccagcttcaggtgcggttggaccggtcacatcaaccactttggttccgttattttcgactggtgccaccggcgcaactggctgttccgcgtcgttggttgggcgggtttcatccaaaattggttgggctggttccttggccttttcatcaacgttgacgactttaattgcggccaacaatggttccgtatagcccatttgattaaccccgacaacgtatgagttgtaagccacttcatctttgagtttgtcgtttaactcgccaaccccaacctgtttgccggcttcagcatatttcgagataaaggtcgatttgtctggaactgccaagttaaaggtaatcccttctgccggacggccattgatggtttgccctgaagtgccgggaagcatgattctaaaggcggtgatcttcgaccagtcggtcactgaattttccagctgccaagtcactgcactcagatccttcaacagatttgcctggtcctcagtggtgtagtaaacgttgactttccctgtccaatcggccggcagaacaaccggaccagtcaaaccggccgtataggttgaagttctcacatcagatgttgagacaccttcaattgaaccggcttgcggtaagaaatcaagtaagtcaagctgtgacaaactctcgtccgtattgtcggtaaaggtaatcttgacggtcgcctgcttaccggtttcaactgcaacggcgtggtgataatcacctttgtcgctttggctgaccaattgattgctctgcagtttggaatctttatccaaaatgtagtagttacctgatgtaatcaaaggtgtcttggtatcaatcaaaccggttgtcgagccgtccgcaattttttgggtcgttgacagcgtggcattattaatcgctgggactgagacaatataattctcagtatcgggaccaacattaatgaagttctggaaaaccatatcttttggcgcactcttatcaatgttgacaatcacccgagtcgcgccgttctttcctggtgttaagttggagatgtctgtccagacaatcttaagcacctgttgaccagaacctttaaagttatcaataactgagtattggttaccaaacggaatgacgccggactgttttgaggcggctgcatcgaacgtgacaccctttggcagaactgtgtaagtctcaaatggcgtgtctctggcaaccaggttaccgagcgaactcttgtccaacacaaacccaagggtcaattgatgagcaccagtctcaagaactgagcccgtggccttgccgtccaggaaaatcgcagaagtcacgtaacgactggcatttttatttggcgccgcaatttcgattgttgacgggttgaggaattgccagacaacccccggccaacctgatccttcatcgatggaggcttgctgttcggcctcgtcctttgccagccaacgccataagccttcaggggcattggcatccgacacccaatcctgcaaactcacataggttctggcattcgaccaactgaccttaggggtcatctgatgcacgatcgttccaggcgttgcgcctgatttgacgacagttttgaagtagacgccgccataggtgccatgcggtgcccaggatccggcaggtaagccaccatcttcaggagatttcaacagatcccgtttcaaaatcgttctttgagcaccgttcttatcggtaatggtgattgtatcattcttataagccttgtacgggtaatccggatattggtagatactttcccgactaatggtatccggattctttggaatgtcacccatgcccttcttatgcatatagagatacaattcgaccacattctttgtcggatcaagtccggctgccaataattgttggcgattgatatagatgtacccgacagaaccatcgttgccgccagtcgcaaagattgggttaccatctttatccttttcgacatctgaggtgatggttggcagattatcaaataaagtgtggtactggttctgtccctcaccctcatatttcacagccagtgacaagtatggattttccttgaagtacgtccattcgccgaccaccccagatggtgtcttggaatccttgatactatttgaaggcaggtagacaaagttgtggatgataaccgtctctaaatcctcacgcggatcgatcgactggtggagtgcataatagttaaagtcacgcagccgttcgttttggggaacttccggatctacatcattaaatagaaatagcggcagcaaagcatcatagaattccaagacagcgttcgcgtcggaataaacttgtgggtccggattgagcaaatccctatccgccaatgcgccaaaaccgtcttttgagccgtagtgaaccatcggtttccaactcccaccagtcacgttccaagtggttggatcatgcggcagtaccatggtagccgcgatcttgtccattagctgattgattggctgggcaccttggaaagtgaaaccgaccccgacatcagtcttaagccactggaagttggcggcatctttgttgaccttggcgatcacttggaacttcagggtttggtccttggcaatttgatccgccacgtcaccggccttaattgtccatttaagaacggttgccggagacccatctttcagttggccggtcgaaatttccggagctgagtcaatcaaaccgttttcagcggttcctttagtcatcccaacataggtctgctcgcccgccagatagtaataaacgttcacatcactacctggttccagcagtgcattctttggttgggcggttgggatcgtcacactgaagtcccaaacggcctgatcttcttgagccggattcttatattcgttaccataggaatctgtgtagacgttagccggggtgttggtcaccattgccgaatacgccatggccatcgtctgtgaggcactcagggtgacaggcgctgagatttcttcagccttaaatgagatgcccatcgtgaccgtttggccattgatcacactgcccttttcggtgccataaacatagtgaaggtcttgagcgacaccactttctaatgtatcccaatggtaggtcaatgtcttagtggtggcatcataaaccggtgtcacgccggcaattgcgtactgggcgagatcgctggcatcaaaggagaggcctttgtcggttggtaagttaaccaccatttccgcgtttgtgtaaattgtccggatcccattggcatcaaaatgcagatcaaatacgccgttatcgccgacatcaactattttagcagtcggtgtaacctggatgccgggtaggatcggattagcagtcttttccggcgcactttccgctaccgctttctcgaatgccattgccttggcgtaagtttcatcccagactttcatttcttcttggtaactcttcaattcaatcagatactggtcatttaactcagccaaacgggtggttaaggtatcataagccccctgggcaacactatacctctcggccagtctgtcgtgaacggctttaacggcatcaaaatcagctttcaattgattgtaagcatcggtcttggcgataaagtcaattccggcatcggtaaattgtttttccaggtttgcaaaggtggtgtgagcttgttgatactgctgattgattttttgatattcagcgtcgattgctttgaattgatcggcagttgccttttgtttttgatcagcatccttgaactgcggctgcaggtcgtcgatttgcttttgagcggcgtcatattgggtcttaactgtctggtattccgcttcggtcttttcataatctgccttggtctgcagataatggtcctggatcgccttaaactgagcatcggtggaggttccctgtcctttctcatactgagctcgggcagcttcatacgcacttctggctgtttcatatttggcgagggcactgtcgtactcggtcttttgagccgtatgggtggtgaccgcagcttccaccttatccttggcagctcggtagtcagcggctgctttgtcattcaatgccttggtctgatcgtaatcctgtttcttttgatcgtaagcggttttggcagcttcatattcggccttagctttctcataggccgccttttcgctggaatactgggtttgattaacctgatatttttcaagcgcctggttatattcggccagtttgtccttatagacggttaattgttgatcataagcattcttggcctgatccagctggttggtaatgatgccgtagagtttcttgctggcgttatacacgttgaccgcttgatcatatgacaaatcttcggcaacggttggctccgtagttgcctgagctggcgtcggtgtggcttcagctgtcttagattccggtgcctgagtttctcctgccttggtgtcagctgccttggtttctgtttccttggttccggtttccttagtttctgctgctttatcagcggtggtattgttggatgttgatggcttggcagctggctggttagtgtcagtctcagctgcttttgtcggctgggctgcttgaggcgtcgctgttgcctgagcaggctgttgggctgcctgtgatgtacctgggttggcagcttccgtctgaccggaattgaccggttgtgactgtggctcagttgttgactcggattgggcctttggagtctgcgcagtcgttgactgttgggtctcagctgctggcgccggttgagcagtttgtggtgctggcgtcgctgtttggtctgcagtcgtcgtagttgccgtagccggttgggctgctggtttctgtgtggcagctggagtggttgctgctgtcggtgcactcgtagttgtcttaaccagttcaggagttgcagtcgcactattacccgcatttccttgggcggtcggcgttgtgtctgcagatgcgtcggtgaccgtacttaactggctgccaacgccaaaggcagcgaccgttaagccggcaatcatccatcgcttgcccgctttatacatcttataatgtttagcagtaacatcctcctgattaataattcccctgtttgatgatttcattgttttttcctccaaaaatgacagtaaagttgtctgcttccccttagcaatattgacatcatttcttttacaatataattatatcaggcgtataaagataagtcataagtaatgacctaatcccggtatgacaagttttcatcatattttttccattactcatcaattatcgtaacgtgcaaaaaaagaacggttatgataaccataaccgttctgatattgaagcgcgttaattaattcctaattttttcagcggtcaatcccattgcattcaaggccacgatgatggttgacattgccattacagcagccccaacggcgggatccaaaatgatgccggcaaatgctaagataccagctgccagtgggatggcaataatgttgtaaccggctccccaccagaggttctgaaccatttttcggttggtaatcttggctaaatcaaggaagtgaagaatgtcactgggttctgatttaaccaggataacgtcggccgaatcaatcgccacgtcggtcccggcaccaattgccacgccaatgttggcttctgccagacttggcgcatcgttaacaccatcaccgaccataatgacgtgattgccctttgcctggtactcagagacaattttttgcttgtcattcggcagcaatccagcatgaaattcgtccaagccaagcagtccggcaacgtgttcggctgctttttgattatcaccggttaacatcactggcgtaatgccacgttgtttcaatccggcaatcagctctttggccccgttcttaatcgtatctccttcggcaaccatccctaaaacctgttggccttgaagcaggaaactaaccgagttgcctttggctgcccattgatcggcagtcgcgttatcaaatgaaatcccgttttttgtcagatagttaccgttgacgatcgtataattctggccgtcaatctcgcctgaaatgccgacaccagggatgttttgcgaattgttagcagcctgaaccttgatgcccttttcttcggcagcagcaataatagcctgtgccagcggatgggtagaattgctttcaagggctgccaatttacttaacagtgattgttcatcagtatttgctgctggtaccagggcgttgacagtgaatttaccttccgtcagcgttcccgtcttatccaacagcacatgactgacgtgttgactggcttcaatagcttgacgattccgtaccagcaaaccattttgcgcaccaatcgacgttgaacgagcgacaaccaatggaatagccactcccaaggcatgtggacaagcgatcacaaagactgtaaccattcgggttaaaccggtcgatagtccctggggtaaccaggcaaagaacgcgatgattcccactgataaggcggcatagaagagatacttggcaaccaaatcagcccgatcctcagcctttgatttcgactgttgggcctcctgaaccattttcatcacttgtgacaaatagccggattcaccggtcccggtgatttcaactgtcaacgttccgttattgttggtagcaccaccaatgactttgtcgccaacattcttgttaacagcggcagattcaccagtcaccaaggcttcattaacggttgattgaccattggtaatggtgccgtcagcaggaatactttcacctgagcgaacttgaaatgattgaccaacttgcagatctgatacttgaacatctttggtttccccattttcagttaccaaatgagcggtcttcggcaatagagcagccatcttttcaacggcatcgccggcacccatgaccgcgttcatttccaaccaatgacccaacagcataattagaatcaaggttgccagctcaaacgagaagtccatcacatgagtggcagtgtgcatcaagttattggcaatgaatgcataaatactgtaaaaatatgaaactgaaatacctaacgtaatcagggtcatcattgccggtgccttactcttaacttcagcccaggcgccctttagaaatggtgagccgccgtaaaaatatagtgccgtatcaaataaaagaatcgcaattccttcaatgagtggggcgtggaagttcaacacagcgacgtccaaccccatgatgggtgctaagagtaatacgggaatcgccaagaccactgagacccaaaacttttgtttcaggttacccatgtgcatcatttgaccgccatgcatcatcatgtcgccacccatatccatgccggacatgtccatatcgccatgatccatctgcatttttgaatgatccatttgactcatgtcatggtccatattcatcttagaatgatccatgctgctcatatcatggtccatattcatcttagaatgatccatgttgtccatatcatgatccatattcatctcatctttattatttgccattttaacgatcctcctcacatgtcattttccccggcagacagttgcattgaaccatttccggagcatccttggctttctcagccaatatctgctgcaattctgcaatgtcactttttgacaattcgcgtgtcttgatcacttgggcaattgtagagccggctcgcatcgcgcacatatgatcaaataaatcgtccgccgcagcggacattgattccttttcgccgacgaccggtttaaaggtaaatggtcgactatcgccgatttgttcaacagcgccctttttaatcaatcggtgcaagagtgtcttagttgttgagtcagaccagccctgtagttcgttcatcgcgtcgatcagctcacgactggttgtcgaccccattgtccaaattgcccgcataacttcccattcagaatcggtgatggtaacatttttagcatctatcattttgataacctcattttatttttcttttaaagtttacatttgtagctctcaacaactacagtttacatctttagcctataagatgcaaccatttctgtttgaaaattctgtttcatccacaaaaaaggcgactgggacgtgtcccaatcaccgttcactcacattaaaaatgtttccccaaaatatccaaactgcgccgttgcccatccatttcggcaacatctggcaaatgtccccaaaccgtaaatccattgtggataaagagcttttggctcggcaggttatggctgaaaatgaaggcaaccagggcatccagcccgaggcgttccaattctccactgacaaagtcgattgcctgctgtcccaagccttggtgacgataatttgcgtcaatgtaaatactaatctcagcagtcttgtggtatgctggtcggccataaaatgattccaagccaacccacccggctatttgatcgtcaaccttcatgacccacaacggtcgggtttcatgattgaactcagcaaaccagttctcacgagaggcaaccgaaaccggctctaaatcggcggtagcaaggcgactgggaataatctcattatagatttcaacaattcgtggcagttcatcgtgcgttgcatattcaaatctgactgacattccatgacctcattttttgtattatccatctattttacgtcaggcaatcccgaggcgcaatatcacgccaacgtgtcacaaatgaacaaaagaggacgggatattactcgttatggaggctttcattgcaactaggattactactttgaaaacttgcggcggccattcaacgaagaaacgcagtcattccaaagtccggaataactgcgtttcttcgttaaatgctgggatcaaatcgcctgtaacttcaatttctttttgacttatttcatactggcagccatccgaattgcgacggcgggatcggttgcctgcagtcgatagacaacactgccagcctgccaagtaatcacttgagctgaactgccaacgttgaatttgacgactccttgggtattcggtgccggtaatgagtagctttcaaacatattgacacttgaaagtgctaatttcttcggcgtcgtgttattcacgggactgccatgaacactaatcgaccagttgccctcgttccaagaaatgtattgctgaccggctcctgattgagtatgaccaacaatcccgtgaccaaggtcaactttcgggagccctttaatttctgaagcagccgtataatcgacatgactttgagcttccgaagctgaagagtagctgcgtttggctaagaccgcatacggcttctcagctttcaaactactgtcgttgagcgcgagtgcatcattaccaacgctgtagtatatggtactgttggtagaattcccattatatctgatatgaacgttcttggatgaatcgttcagtcccgaattttgtggcaataacgtatctgacaacttacttgacagatccttagtcagcgatgagaaatcgtacgattgaccgtctgattgagcgttgctgtcagaagaagctgttgaggcactttgtccgctggtggtatcagagctggtggtcgaactgcttgagttctgcatatcggtctttgattcattattagaactttgtttaccggaattgccattactgcagccgacaagaaccagactcagtaataacactccacctaatttatagagcttcatcgtttccctccaaattgtttgcgtgaattattgtacgaaattcttattggcagttaagtagcggccgtcggcagtttcaaaatagtatgaaccactgtctcgtttgtgaattaccgtcacgttaactttggttcccggctgaactttaacaacccggttggctttcttaaagctggttgaatcatacaggtacagtttctgagtggtcgtgacgctgctgacaacgtcggtgaaataagttggttgcgcagtatcagctgactgagctccgccgatccaccaagtaattggcttgctggaattcagaattgtgctggcgtcaactgattctttcaatgcgggaacgtacttcttattagtgtactgccacaaatcggtttgaatggttggccgtgaagaataattggcgatccattgggcatcaaaattctttctggcggtgttggcatgagccgttgcaaaggactggtaggaataaaagattaatttcttaccggttaatgaacgcatttggtcgtaccaggccttaacagcagcattgcttgaacctgaagtcacgtcattttcttcgtagtccaaaacgtagaatttggcgttcttgttggaattttgatagaagacgttggcttcattacgggcactggccgcactggtgaaggtggcgtaatcatattcaccaaatggaatgccatattggacgtataaattggtgttattggtcgcgtacttgtcttgatagttagcgccatattgccggcggttaataatgaaggaaacctgactcttcaagtttgaaactttcgaagccgttaatttcccctgccactctgaaatatctggaatgacagttgtggcagccgatgccttaactgccccaaaaatcgaaaccgataagataacggtcaaaatcgataggatgatcgcccgtccctttttcctcaatgaactcatttaaaaccactccgcatttatttatttgcttacgccaaattcaattagctaaacagttgtcgtcaatttctctaccaacatatgacagaatgggtttgagcacaagaagcccagcagtaagcaaaaagaatattacagagctgagtcgcgtcataaagcctcagcgattacttcttttcaagaatgttataaatgtgtaacataactgaaaaaatatcactccgacaaccgtcaatgaataaatcggaatgcgtagccaaatcggcatcagccgataacaaaagggttccatcagctcgatggaaccctcaagataattgaaaaattatttaacagctcgtgaaactgcctcattaacgtcagctttttcagcttgaactaactgaacccgactatcaatgacactaatatccatcttgatttcgcgagtcaaaccaggcgttgggatctttggttcaaagaattctttgaattcagccaaccgttgcggtgtgtggaagatacctgaaataacggtaatgtaggtggcaaattccatatccccaccaaccgtatcttcgagccattgccagtcttttcgaatccagtcccaagcagcttgttgaccgtcatcattggcgaggaccccacggaaccaggcccgcaagtcttgcggtttgatggtgtcggcattctcaaattgaccaaccaacttggcaatcaaatcggggtcagtggtactcgtcaaagtagcgcaaatgtcttgcttgtaactggcatcggcagtttgccggtaagcagccaataatttgtcaaataaggcttgactgccaaagttcttaacctcatttcgaaggacaaacacccgaatatcagcagataagccggccagactgccctcgttttgtttaaacaacgtatgagctgcagccatggcatcagcgttttcagcatacaatgaagcacttaaaatgtacggccgagtcaattggtcatcatttgactcaccagccttaggggcaaagcccagtcgatcaagttgggcagcactcagtcgatcgaagaattgcttgagtgctttttcttcattagatttaggagtcacaaatttcttcaaattgttggcaacccgatacattgccgcattgacaatgttggaatggctgtccgcaaattttggcagcaacggcacaatattagcataggaattttgacgaccatcagctaacaaacggaggtcttggagaatctggagctgagaaatcgcgtccagatccgccacatgatcaagaatatctgccattgaggtttcatcatattgaataatgaaatgtgaattgttaccaacattcaagaagaatggtttgccgttttcttgacgcaactgttgataatcaccgactgtgagtgttttatcagccatgatttcaggcacggcgtcgtaattgctgttaagcggaatctgccacttgcggtcgacatccttgccgtcaccaatgaagaattgttgttgtgacaaggtcaactggccgttttggactttggccgtcacaactggatatccaggctgctccagccacgagttcatgatggcacccacgttcatgccagaggcgtcgcccaaagccgaccataaatcggcaccggtagcgttatggaacttgtgggcggcaaaataattcttcaagccttcccgcaaggccttgtcgccaaccaaagctcgggccattactaacattctggcacccttggcatacacgatggccgagtcaaaaattgaatcgatctcggccgggttttcaacttggacgtgaaccgactgaacaccatcggtagcgtctcgttggagagcagccggggcttcagaggtctggaagacttcccaaatgtgccaatcaggctcgatcgcatcgattgcaacgtattccatcatgttggcaaaactttcgttcaaccacaggtcgtcccaccacttcatcgtcaccagatcaccaaaccactgatgagccaattcgtgggcgatcacggtggcaaccagctgtttcatttcaaatgaggtgttcttgggatccaagagcaggtaagcttcacggtacgttaccaagccccagttctccatggcaccggcagagaagtctggaagagccagctgccatgagtgtggcaatgggtacggtgtttggtagaagtcttcataaaattcaatcgaccgtttggcgatatccaaggcaaaatcaagctcatcggccttgtgcgccttggtagcaaacacaccaactttaacaccgctcttggtggtcgtttccttactctgcatctcaccaaatccaaaggcgatcagataagtcgacatcctcatggtcgtatcaaaatagtgaacaccattttctgtgcggacttccggcatgttgctgatgatcgtctcgccggcatgctcgtcaaacttaatggccaaatcaaaggtggctttggcttcgggttcatcgacacatggaaaggcctgacgggcagcggtggtctcaaactgggttccgatcagctgcttcttaacgccatcaacttcgtaataagatggataaatgcccatcatcgtgtcagtcaatttggcactaaattgaatggccaaggtcacaaccccagttgtcggcaaatcaatattgattgcttcctgatcgtcgtccttactaaatgaaacggctttgccgtcagcttggaccgattcaatattgagaaacttttggtgaatcgaaatcgcggtcgtcatcgcgtcacctgtaatcgtagaagtcccggaaaattccttggtatcccggttgatgtccagatagatattgtaatgacttggttgaaatttttcgtagaaatgggttaattgttctgccatgagttgcctccttgaaaatttgttaattatattatacgactctggcaacgcttatgcggctcgaatggcaaaacattgatttttagctgaacatccgcgtgaccagtcgatcttgaatccgatcgggaatcaatttcaacaatttggccgtcacttgttcttgaaatcttatctgatagcgtaactttggtttgcgcgtcatggccgctttgacaatcacttgtgccacatcgttggtagttgcccgactgtcctttaatgtcttcgctaaacgctcggccacccgccggtagggagaatggattggagtagccgccaacagtttatccacggcaattttctgccatccggttgctgtattgcctggttcaaccacaaccacatcaactccaaaaggtttaacttccaaccgcaaaatatcagacatggtttccaatgcgtgtttggaaatatgataccagccgcccagttgggtatacatcaaacccgccagagaagaaatattaatgatgcggccggacttttgggttctcatcgtcggtaagaccaactgaattaatcgaaccaacccgaataaattgacgtccatttggtgtttggcttcctcgattgtcacttcttccagcgcgccaaatgaaccgtagcctgcagaattaaccaacacgtcaactctgccatatgaatccaagacaaaggctacaaaggctttcaggcttgactctttgttgacatccaattcatgaacctttccgccgagttcagtcagcaccttcatttgttcaacatgtcgcgcaccgccaaccacgtaatagccctgcttcaaaagcagtttggcagcagccaggccaatcccggacgacgcgcccgtcacaatcgcaacttttttcatcaaaaagacctccgtttcataagcgataactctatcgttaatgcttactgtgtataatagcgatagtcttatcgtttgtcaaggttgcaatgccggcactttccaatataatgaagatatgaaaattaaaacgacagaacattataatcggattattcagggtgcgaccgccattttactgaccgaggggttggccgctttttcgaccactaaagtcgccaaacacattcaaatggcacagtcgaatatctatgtgtacttcaaaaataaagatgatttgctggtgtcggtctttcggtaccaccagaaaaagtacattcaatttttagtcgatcgcattgatctctccctgccacccacggatgcgcttaaaaatttggtttcaacactcgatgaattccatagcagcgacaaagaatcactcgatgttatttggtcaattcggcagagcaccactttacggcaactgattccaaaagtcagcgacgatcaaatttttattgccatttttcagtggctgaaggatttgcagcatcaaggaactgtccgccaactaccgctcatgtatctcaccaatttggtcttttccgccattatcgattactttcagttaattgatagtaaggaaatgtcaccaaacgagctggctatcgaggaaattgtcccacccttatcagcattactctttgtctgagagaggcttgtcggccggcctgattactcgtatacttaaattctgacgtgctggtgattgaacaatcagcaccaattgatgcgaaattcattattctagggggaatcgtcatccaaaacacaaaatctcagcgttgggtcggcctgatctcgggactgattttaaacgcctttggcaatgcgctaaccatttcagcgaacatgggaagtgccgtttggactgcttctgctgttaactacagtcactggttcaatttgaatgttggcattatcctgttttttatcggttttttgaacacggtcaccaaccaagtcctgctgcgacatccggattggccacggttcgttggcgaaatcctctatgtctgcttttttagttatttcgtgaatatctttgcccaactttttgaccaaattgggatcggccagttaccaattgtgattcggggcatcctatcatgtttggggattatcttcttctgtacggccatctcactgtatcagcgggcaaatattctcatgcatccaaatgatgataccaccaatattttgcggtttatgtatttgaaaaaaagtgccgtggctgcccagctggtcgattttgttccgccaattatcgcgatggtgatttcctttgcggtgacccacaatttgtatgccgtcaacgtcggaacgatcttttcgattcttttcaatggcttgattattcaaaccgctgatcgatgggtttggccgactttgaagcataattttaaaactttggggaatgattagtatcgtcaccaatgttctaccccttcaattgaatggtcgctacagccaaatgaaatcataaattgtcggtaaatccagttgcatcttcccgttaatatggtaaattaaaactaaataagtcagacttaatcgctatttagaaaggagcttggacaatgatctttatgttactcatgctatttttagtggggtatttggttctaaatgtcagttggctgttcattaaggcctcggcttggctgataatactcgcaattgggtttctgatcctgtccaaactgctggtagttgggctgatagtcgccgccgtttatggcgtttatctgctttttcaacgctcacaaattcagccatacaagaatcgccactaatccaattatcttgaaaatgttttacataaagagaaataaaatcattcaattgatcttatttctctttatttttagataattttacgattttttaaactttgtaaccgttttgatagaaaatttctttcataaggtatagtattacattattacttaaaattgaggagagttttgattatgaatttacttattgcgttacttcccgcccttggttgggggttaatgccactaataaccggaaaagtcggcggatcgccagccaaccaaatctttggaattggtgccgggacgaccatcatcggattgattgtcttcttggtgacccgaccggccgtcaacatgactgcgtttctttttgcaatcgtttgcggtgctttgtggacgattggtcaaatcggccaattcatttccttcaaacgaatcggcgtgtccaacacctacccattatccacggtgtttcagttagttggtaactcgattcttggcgtattgatctttggtgactggcagggaactcaatccaaaatcattggcttcatcgccttgattattgtgattgccggagcgttgttaacgtctgtcagtgacgaaaaaggcggcaaaattacctttaaggacgccacgttcttactttgcaccaccgttggttactggatctattcgtcattccctaacattccaatcattaaggcacaaagcggcacttccgttttcctgccagaaatgatgggcattttaattggtgccgttattttcggcttgttcaccgaccgtcaatcatttaaacaaaaagaacaatacctcaacatcatcgccggattactttggggagtcgctgcgctttcctacatttactcggctcaggcaaacggaaacacctccgcattcatctggacgcaattaagtgtcatcattgccacttttggcggaattacaattctgcacgaacacaagagtcgccgggaaatgatctttaccattgccggcatcctgttgattgttgttggtagtgttgccacctcgtttgcataattaatagatcagttgaagttgaaaagagagtgggacttaaggcgttttgatcccagaatttaagcgcacagatcgattattcctggttttggaatgattgatctgtgcgcttaaatggccgggatcagccgattgccatgtaggctaggcaagcatgctggccgtcgtcgcacgtttttgataaataatatgggatcacaagaaatagaggccgaggcaaaagcgtatacttttgtctcagcctcttttctatttggatttaaggttgtccaatcccactcttggtaaaatcattgagcagacgggcggtgacccgcttaaagaagtccttcatgaataggccgacgatcaagcccccaatcagcatgcagatcagaacaaagaagtccaagaccacggtaccaacattgggtccaccaacggcctcgcggaagccactgacactgtatgaaaatgggaaaatcggctgaatgattctcatgaacaacggattcaactgaatcgggtagattgccccacttccggctaattggaaagcgaccatcatcactgccaacgcctttcctaagttaccaaacaccgacgccattgtataaacgattaccgagaacgtcagtgatgacaccacgccgatcatcaccattaggaacaaactttccacgtgaaccctgagaataaagacagttgaaaggacaatcaccatcgtttgaatcatcgacaaggtgttaaacagcagcatcttgccgatatattcttcacgcggccgcaaatttttgaaacgatgatatttgggcgccgaggtgtgcagaactgcgaccagcatcgcacaccctacccaaatcgatagggccatgtaagttggtgcaaacgcctcaccaaatgaactgacccgataaatgttctcatttttgacgttaaatggttgggccagtgcgttgcccatcaacttgggattgttctggaggatgctgataatgttggcaatattatcgtctgaagtcaatttcaactgattacttgcctgcaaaatcacgcccttatactggagcagttggttctccaagttgccggtggtgtcactgaccagttgattgcctgaaataatcgtatccaacgacttttcgttcaagctgcgaatgtcattaacattgttcaagacacccgaagcgtgattgctggctgacagcaggttgcgttgaatcccgttcaattctgatttaacgttgcgattataactcgccagtgaatgattcaggccgctggcaactgaataggaatgactggcaattcgctgctgcaggccggtattggccgtactgcctgaactaagcgcccgctgtagttgggtgacttgctgagactgggcatccaggagattcttgacgtcattgagttggctgattaatcgactcaccccactcaaccgctgcgattgattaatcgtctgcagataagcaattaatggcgtaatctgccctctcagtaacttaatctgcgacaaaatttgactggccaaaccagtggcctgattacggccggccgcagaagtctgcttgttcaactgattggtgagggaccgcagtcgtgcggcgtcagtttgaatcccattcaagctggtttgaacgttgccaaacgattggttaacgccctgattcacactccgaatcaactgctggttcgacgagccaatcgcttggttaatattgatatcctgagatgctgaaatcaccggcttcagttcagaaaagaccatagccagcccgctggaggcttcactgatatctcctaaggtattggttgccagttccatactgtctccaagattgataatcaggtcctttaaattgagaatctcggattcgttgtcaccagcctttttaccagccacattcaaataggtaaaaatggtgctgttaacttggtatacgaattgttttttgatcgtgttcaacagcgtctttgaggcggcttcggtaattttgtaactcattggactggccttggtgtcagcgatatagtcgatgtgggccttcttcggattagcagtcacaatactgcccaaatcagccgaaaaggtcttgggaattttgatttcggcgtaatactttccagcgcgaactttcttttgggcagtctttgaatcaacaaaccgccagccgatctgattattgtgttttaactgggctatgatttgcttgcccaaattcatctgtttgccttgaactgttgtgccttgatcgttattaacgacggcaaccggaatcttttgaacctcgtgggaagtatacggattccaaattgctttgacattcaccaaagtatagagacaaggcaaaatacaaagcgcgctaatcgtcagcaacgctgctttgtacttaaaaattgccttgaggtcccgttggtaaatcagtttgatatttttaaacattgttccatccctcaaatttccttgctacttgtttctgtcgaaaaatgcattatactgataataacgcgtatgcgaatgattaacaatggtaactatagttaacaacattaacctacttttatgagggagctataatattatgaaacattcagttattaaatggatactatcactgaccatcttaggggcgctatttgctattcaaccaaccaccgcgtcagcgaaaaccacagcggccaaggttaccagcacccagactttaaccaaggcaccctaccgtgcagtcagtggttatctgtacagttcggccaaattaaccaagaaggtccataacgccgacaattatcctttaaccaccttttacgcttctaaatcggcgaatatccaacgggctaacggcaacaaggcagtctattactatgtcaagaatggtaacggtaaggtcgccggttggatctggcgcggtcatctggtaagaatgatcaatgtgactcgtcagcgacaacaactgaatcagattatcggcttgattgatacgttgtccaccaataataaggaccagctgatttcaattctcaacctgatgaatcatcaaagcaccctgcccgacttgctaacccagttaaataactggatcgaatcaattcaaaatgatccagatattgccaagctcaatcaaatctttgaaatgatcaaatccgatggtcaaacactcaattacttgttcagtgagggaatcaacaagctatatcccaagatcgttgtcattcataacctgaacaaccgcgtgtttgcgctcgcccaaggactgcttgatcgaatcaattaaaaggacccatttatgcgaacaatattaaccttactcaaacgtgacttacacaatatatttcatagccggccggtgtggataaccctgctggctttttgtctgattccggccatttatgcggtccccaacatcatggtctcctgggacccgtattccaaggccaataccagtcgactgccgatcgctgtggtgaatgacgatgagggcagcacggtcaatggcaagcagctgaatgtcggcaaacaaatcgtcggcgaactcaaacaaaaccacgccatcaactggatcatgaccaatgactggcagggaaacaatggcttggatgaaggaaagtattactcgctcattgaaattcccaatgacttttccagcaagttggccacactagtttccaccaatcctgagaagcccaatattatttataagtccaatgaaaagttaaacccggccgcaaccaaaattaccggccaggctgtcgacacgttaaccgagcaggtgcgggacagtttcatcaaaatcagtactaaagccgccttaaaagaaatgaatgccgccggagccaagattaacacccacaaaccggagattctccaaattcgttcctcactattggatgccatcaacacggtgaagaaaaccaacggctatttggataaagctaacaaagactcagacaatgtcgagcaatacctgaagacggtccagggagacatcccgaaaatctccagtcagataaccgatctgcaaaatgttgtcaatcatggccgcaacttaaccaaggccaccaagcaatctctcagttctgcgcaaaatgatttatcaaacggattaaatgaccttcagtcagataataaccgcatcaactcattggtcgatgacatgcagactggcggacacgcttcaagtaagtcgctgttaaacagtgaaattaatcaactggaaacgctgaatgagtcgacacttaccggcatcaataatgccctgcgaatcgccgatgtgttgaacaacttactgccaaacaatcagacgacttcgctgatcagaagcctcagcaatgccaaacaacacgtccatgagcagcagcgcaatttaaccagcctgaaaaacgctaaccaagacaatcgatcgcaaaaatcaattaatcaactgattaagcagctcgcaaaaacgaccgatgctttgggtaatagtctgactaacgcgggatccacgttcaccaacacggttagccaggcgattgacgacctcaatgataccttggacacccagttgaacggcaatgatgaagtgctgtcatccttaagaaccctgttaccacagctaaatgcgttaacttcggctggaaaagcaatcagtaaaatctccgtttcccaggtcaatcgaattaaacatcgcttaaacggcattgaagataaactgaacgacttaaatgaccaaaccaaattcatcaacgaaaagaatttgaataaaatcattaacttattgggtgaaaatcccaagatttcaaatttgctggcatccccaattaccttgaaacaaaagcagctgtataacatgggcctcttcggctacggcatggcgcccttttacacagtcttatccatgtgggtgggcgtcttgctcctcaccacgattgtctcatggaaatacctgattccagaagacaaacggtttccaaaagccaaccggattcaacaatacgttggtaaaggccttctgtatctaattctgtcatttacccaaaccaccttcatcatgcttggtgaactggtcatcattggactgcggccacgaagcttgttggcaatgttggcaactgcctatctggcaacgaccgttttcaccatcatcatgttcacgttggtctatatgttcggtaatatcggcaaagtctttagtgtcttgatgatgattgctcaactatttggaaccggtggtgtgtatccacttgaactgattccttcccatttggcaagcttggcaccgttcctgccatttacctacgtcatccaagccttcagagaggccattgctgggccgattccaagcgtctattggcacgcaatgctgattttggcggcgtttggcggattcttcctcctaatggcgccattgtggcgggtgttcgtcaaaccactttcgaagatggaaaatgggttccataagtcccagttgtaaaattaaataagtgtttcaaaaagggcccacaaaatcagcaaatggttttgtgggccctttttgtaccaatttacacgcctaaaggattctgcgcatatccaacccccgggcactgcggatgttttcaatcacaattaacgcattcttatcttcactttcgatgatcggtaccaatttggtgacccgccgaggaccagcaatcatgtacaacatgtgctgatcagcatcactataatagccagtgccattaaaaatcgtcatttcctgatttaattctttggaaatggtcaccgcaatttgccggtactttggtgaaaccaccagaacggcctttttagcaccaatattcgccaaaaactgattagtgaacacggagtaaacgtagaggtagatcaccgttaaaacggtattggtgaacccaataatcatgataaacggaaccacaatgaacaggtcgaatatcaaactcccggtacccagtgagatgccaaaaaaataattgagaatcttaccaataatcgtatctccagcaattgtgccgttgaagcggaaaatcaaaccaattgagatcccggttaaggcgccggctaacagcgtcggcacaatcaattcatgggtatgatatgtataaaacaccggaattttgaggaacaccgtcatccaggcaattgcccaaattgtcagataagtggttttcttttcaaacaacctgtagccaatcacaattaaaacagcattgataaggaggtttgacagatatgacggcaccccaaaagcatagtacaacagtgctgtgattcccatcgctccaccttcaccaaggtgagaaggcaacaacagatagttataggtcatcgaatagatgaacgcccctactgctaccccaattaattcggtcgatttaatatttagttttcgccaataattccaaattgaattcatttcgcacctcaatcttgatatgtgattttcattctaccattaatggggtgcggttggcagtccccctttcattgtttaggctgaaatcatgaaaatcacagaaaatataaaaagtccaaaatcaaaatctgattttggactttcataatatcaattaatttgttattcccattcaatcgttgccggtggcttgctcgtaatgtcatacactacgcggttaatgccatcaacttcgtttacgatccgagtggagacattttgcagaacatcccatggaatccgtgcaaagtcagcggtcattccgtcaacagagttcactgctcggatggcaacggtgtaatcgtaagttcgaccatcacccatgacaccaacactcttaaagcctggtaaaacggtgaagtattgccagatatcgcggtctaaaccagctttagcaatctcatcccgcaggacccaatcgctatcacgaacgatcttcagcttttctggagtcacttcaccaagcactcgaatgccgagacctggtcctgggaacggctggcgccaaacaagcgtttctggcattcccaatttttcaccaattgcccgggcttcatccttgaacaacgtgttcaaaggttcgatcaacttaaacttcatgtcttctggcaggccgccaacgttatggtgagacttgattgtctgagcagtatcagttccactctcaaccacgtcagtgtacaacgtgccttgggccaagaaatcaatgccgtgaagcttgctggcctcatcgttaaacacttggatgaactcattaccaataatcttgcgtttcttttcaggatctgtgacacccttcaacttggaaaggaagcggtcctgagcgtccactttgataatgttcaagccgaatttgccgaccaaactatccatgacctggtcagcttcgttcttgcgcaacaagccgtggtcaacaaaaatacttgtcagttgcttaccaattgctttgtgcaagagaacaccaacaacacttgaatcaactccaccagagagacccagcagcactttcttgtcgccaacttcttctctgatatgttgaatctgcagatcaatgaagtcatccattgaccagttggcctctgcatggcagacgttgaaagcaaagttcttcaagatgtcgttaccatacttggtatttctaacttcagcatggaactgaatcccatacaaattacgctcaacatcctgcatagcagaaattgggcagtcacgactggtggcaactgtctcaaagccttcaggaacttcattaaccaagtccccgtgactcatccagactggctgctcacgtggggttcccttgaagagaactgcatcatcagaagtaatctgaatatcagcatgaccgtactcggaattggaagccttctcgacttcaccattaagggtatatgccataatctgcatgccataacaaattcccaagattggaattcccagcttgaagatgtctggatcaaccttcaaagcgccatcttcgtacacactatttggacccccggagaaaataattcccttggggttcatgtctttgatctgttttgcggacaatgcgtgggacttaagctcagaatatacgcctaagtcacggatccgtcttgtaatcagttggttatactgactaccgaaatccagcactaaaatcttatcgaagcttgataagtcaacgtttgccaaatcatacaccctttcaaagttcttacataaataataaacgattcacctaggtttggtcaacattattctgaaaatccaaacattaatattttctcaggtacaaccgatcgatcaaatgattgtccgtcttgtgcattatcatatcagctcgcgagcgagttggcaggatatttgctcggaggttgggcaggtcgatggtgtcccacactctgcgggccatatcaaaggcctcctcacgatccccttgcgcgtaatcatagtaatagttgtcgggatcttggaaggccgtgtccatcaagcggctgaatcgttccaagtaccacttctcaatcaaatggacgtcagcatccatataaatcgaaaagtcggtgaagtcgctgatataaatctgctcgttgctgggtaactgcaacgtattgattccttcaatgatcagcacgtccgggcgatcgaccaactcaaagcggttgggaatgatgtcataactttgatgggaatacaccggtgatttggtgaccggaactcccgacttgacctcgttcaaaaatgcgattaacttgcgcatatcatagctctcaggaaaccccttcttgtcataaatcccgcgttgtttcagctcggcattcgaatagagaaacccatcggtcgtaatcaacttaatcgtctcgccggtgaagtaattggaaagcagttcctcaagcacccgggccgtggttgattttccaaccgcgacacttccggagattccaataataaacggcacggttcgcacctttttgcgcaggaaccgggccttggtggtctgccattgatcaaagttgtttttctgcaggcgaatcatgtgcaccaacggtttgtaaatgtcagcaacgtcctgcaacgagatttggtcgttgaaggccttaatgtgccgcagttcgttagacgtcaacggcaaatcgacttcattgtcattattaaaatgtttccactcatctttggtgaatgaataatagtttattaaatcatccatgcattttctccgcttattctttactcaaccaaataagtataacattttcagactgccccgagaaccggagatatgttttcacttgaagtccgccagccgacataaattaggtaataaaaaatcggaccatttcgatccgactcatgcttaattcaactcatattcatcttggggcaccgtctcaaaaattggtgacaacgatttgactgccacaaccgtcaatcggtgcattgcccgggtacaaatcgtatagaccagttggcgatcgctttcgtccgggtagcaggccttcgaagcatcccacataatcacactgtcgaattccaaccctttggcaaggtatgaaggcacgacaatgatgcccttcaccaaacgctgattttcagttcgaatcaatgttgacttgacacccagttcagcgagtttgccactcagctcttgacattctttcagtgtcttgccaatgatggccgtcgtttcatggtcggccaagttcaactcggactgctgtttaacctgctcaactgcagcatcaaccccgtccttgacgtaaatgtgcggcaggtcgccttgacggttgaatggaataatattctcaccattggtcaacaggtgcttggtaaagttggtaatctgttctgttgatcggtacgacttggtcaattgaaccacgcgggtcttatcctcagggaacatgctgccaagttcgcccaacaatttacggctgttttcatgggtgaaaatcgcctggttcaaatcacccagcagcgtgaatcgcgcccttgggaaactgaattttaagaaggccaattgaaaggctgaataatcctgcacctcatcaataaagagataacgaatatctttatcgccacgtttaccagtcatcaagtcgtacaagtaaatgtacgatgacgcatcagctaatgacaatctgcccttcttcaaacggccgacggtggctttgatctcttcggcccacaactcgttagaaatgccaaaatcagccagattgaggatctttggcatctctttaagcatatgaacaaactggttattgatactcaaccagtggttgcgagaaatttgccgctggacttttctaaatgacttgataacaatccgtcgggccaggaacttgaattccttatcggcattgagaatttcttcttcaccttcggcatggaactgttgaatttcttctttagataggttttgaacggcatcttcaacccactttttccgcatttcgacgtgaatcttgcggttaagaatcttcatcaattcttccttggttgactccagtcggttgcggagattgtagttctcattgaaaccataatagatttcagcgatcttttcttttggaatcagaatgtcaccgttaaacatcaggtttctaaagcgcatgtcttccttattcaaatggttagcgtaagcactgactgctcggaaataatccaagctgcctttgacgtcggtcagcttctgggcagtcttgtccagctgctcagtaaagcgctcagacaaggtttcaacttggacactcggcaaacgatgtgaactatattgatagaacgtcatctgaaccatattctgctcgcccagttcagggagcacctggttaatataatcattaaacagttggttcggtgaaaataaaataatttggccggaatggaggttgccgcggtattggtagagaagaaaagcaactcgctgcaacacagcggccgtctttccggaacccgctgagccttggacaaacagtaaatcagaatcggtatcccgaataatctggttctgttctttttgaatggtggtcacgatgctcttcatcttggtgtccgaacggttgctcaaggcatccaggagcatctggtcacccacgacttcttcggtatcgaaaactgttttgatctttgaattttcaatttggaattggcgctttaatttgacatcaacggtctgttcaccgtcgggggtcatgtaactgacatcgccgatcccaccgttgtaatagatactggagatcggtgcccgccagtcatagatcaggtagtggtcgggccggtcggtaaacgatgccatgccaatatagatggtctcgtctcgtttttcgtccccttcacgaaagtcaatccgtgcgaaataggggttctgctcaagcttgttgagcgtcccaagttctcgggcggcatgttcctggcgattttcacgttcagaaagcatttgctgttgctgccgaatggacatggcagtttccatcatcccgctgtacgtttcagttttgagccgaacatcattgttgaaattgcgattgatatctttaacatcccgcttggtcgccttaatcttttgctcaaggtccttttgggaaatgtggatttcatcaatgacgtggtccaaatggtgttgttcttgtgttttgatattatctgccattatttaccccctataacttgacttaatagtttagcataaaaacggtaccaattcaaaagacattatcgtttctggcttaacggtaacttaaatggcctgacattgttaattggtatacttgccattcgaccgatacactatggtataattgagatgttttaaataattgtatacttaggaggacacatatgacgatctcactatattttgttagacatggtcaaacatacttaaacaaataccaccgtatccaaggagtgatcgactcacccttaaccgacaagggaattgccgacgcagtggcagctggcaagcggctttcacaaatcaaattcgatgcggcgtacagcagtgatacttcccgggcaatcaagaccggccaattgatcttgaaagaaaacccggcagcaatcaaggatccagtgccaaccggtgcctttcgtgaactgaactttggctactacgaaggtgaagatgacgtcaaaacctggcatacaattggcggccccatcgggatcaactcgtttcatggcttaattgccgaatttggtattgaaaaggccgaggacatgattgcggcggctgatccatacaaagatgccgaaagcggcggaacgttctggaaacggcttaaacttgccattgatcaggtagtggccgatgcccaagacggtgacaagattttgttggccacccatggcaccctcatccgaaatgtggttgccaaattcagtgacattccagtcgatgtgtcaaccaaaaacggtagtgtcactaaggtcaactgggacggcaagagctattcggttgagtactttaataatgtgagtgaagatttatagaagaaacccaaacagccgcgagcaaaattctgctcacggctgttttatattatttaactggattgaatcagtctcctcagctgtcaaaccagcccctattgttcgttgaaccgcttcttcaatttggcctcgctaaacgccatcaaactatccgggtcaacttgatatttgtcgcaaagaatcaagacttgatccatcacatcggccaattcttcatgcagattttcattgcgtttctccctggtctcatgttcacctggatgatcgcggccgatttcaattgctcggatcgcccgggacaattcaccgacttcttcagttaaaaagttcaggcgaatgaacgaggagtatttgtaccaatctcgtcgcttgtaaaaatcgaccagccaatcttgatgctgctttaacgtcattaatcatcactccattgtcttatgtctacttaaaatcatacacctcaatgcttggttttccaggtcaacaaactaatggccgtacaaacaacactcggaatcacgaagttcggtaccatcaagtcggcaatcgtctcagaactagccaacgcccagccaaaaagtgaaatggcaaaaatcaattcaagcaccaaccaagttgctatgtacgggtgttcagtgaataatttatcaatcatctcctaatcttagtaaaccacataaatttgaagaaaatatgaccattctacccacctgtggtctgttataataagggcaacagggggttcacatcatgaaaaaaattttgccagccgcaatcatcggactcgccggtattttgcttctcacaggctgtgggaacaaaaaagccgacatgcaggataaaacgacggccaatcccaatgcaaccaaattaaatcacttgttgtcaccggcaaccgccaaggtcccggaagattcgcagacaacgaccgataaccagctttattcccaattttataagagcaagggtcagtggtactggaaactatcttccaaacaagccgggaccattgataacagtaaaatcaaatcacttagcgccactgaccaaaaagatgtttataatttctccatggtcagcaaccagcgcaagtcttacacccttaaattcaattggattaacggcggccaccaagcttatactgtcaatgccagctaccatcatgtcaacagcaatttcatcttggcagacgccaatactgacactgattggcagacaggtgccccacaggccgtccagggaacttgggcaaccgacttcgtcaacaactcaggtagcgacgcgcaaaagctgccttataccaaacaatttttgaacattaccagctccgctatcagcagcttcaccaatgaatatgacaccaaccaccggctttacaactcagacacgattgctaaagccagcaatgtttcctacaagcaaaccggcgatgacacttacgtcttaaaagcctacggcaatgaccaaacgccaatcgtttataacatcagtgtccaaagtaacaatcaaattgaagtgaatgggctgacctcgggcagtttgaccatgagcaaatcagccactactgaaccaaccactggttcacagacggccagttcgcagtccccatcaacgaccagcggctcgactgccaatcaagcagcgacaaccaccaaccacctcaccgatcaacaggtggtcaactggatttggccttacgtaaaagccaagtatccaaatatggccgtcgattcaaccgactttacctacatgccacagatgagaaacggtcaactgtacgtcaacgttttggagaatcacaactctcaagcatttaagaagagtggcgttgataccggcactaatccacaagtcgccagctttagggtcaccgccagcggtgctttggaacagatggacgcaacgacaggtgactgggcagttgtttccaatagctatggcggatagcaatgaccatctaatttagttttaaaaattcaaaaagtacccactcctcaatcgggaatgggtacttttttgtcggaccagacgcactgttaatgcgtgctggctattttaccttgataatccttatcaatatgttcgtaatgatcaactttgtatttcagcttatcgtaggatgcctgcattttagccaggcgttcactgacggatgccagctgttcgttcaagagatctttgcgtgcctgaacagtctgcttgccctgcttaaacagagaaatatagtcaatcaaatattcaacactgacaccggcgtctcgcatacacatcgcaaaagagacccagttcagatcttcttgatcatagtttcgataaccggcttgatccctggaaacagcgggaatcgcaccaacccgctcccagtatcggagcgtgtcggcggcaacactaaattttttagaaacttcgttaattttcatcagctcacctcattactaactgatgataaaccttgaagtgcactttaagacaagcatttcctacagtttgataacgagcgagtcgttaaccagttaatcctcgttaatcggcggcagctttttaatcaattttgccggaacgccgccaaccattgcgttgtctggaacatctttggtgaccactgcgccgccggcaatcacaacgttgctgccaatggtgacgccgggcataatcgatgccttaccaccaatccaaacatcgttgccaatcttgaccgggaacccctgagccatatactttcgtcgctgaagggcatcaaccgggtgattgaccgtataaataccgacgttggggccgatcatgacattatgccccattgtgactggtgcgatatccaagatggtgagattatagttactcaaaaaatcttctccgaccgagatatttttgccgttatcacaattaaaggttgcctgaacggacacccgctcaccggttttcccaaaaatctgcttaattttagctgtttgcttatcggattcagttgccggaattgaattaaattcctggcataacttggccgccctggcctttctggcagcaacctcatcatctaggaaataataaggttcaccagcatctaatttttctaattcagtcacttcaaatccactccttatagcctaactgatcagtatgtctggcagttgcgacgagattcacattttcttgttgtgccaagtaagcggccaatgagtgaccaaatccagttgaagtgccagttacaaaccatgttttatttgtcattagattttctctccttgtttgattagattacacattcatgctacaactttaaccaaggtttaagtcaagtcaaaatattggaaagaggtatccatatgtattctattggagatgtggcaaaaatcatgggaatcagcacgtcggcaattcgcttttacgaccgcaaggggctgttgcccttcgtagagagggatgacgccggcagacgaaaattcaaaccaaatgatttgaatttcctggaagtcatcgactgtttaaaacaaagtggcgttccgatcaaagatatcggccatttcatcagtctgtgcatgcagggggacggcaccttgaagcaacgctatgactatttggatcaagaagaagctgccctgcagtcaagcatcgatcggatgaagtcgcagctcgctttcctgcgctataaaaaatggtgctacaaaacatccgtggaagccggtaccgaatcaattcacttcgccccgggttccaacgttgttgatccaaagaccaaaagtcaatatcaagaagcattgcagcactgtaccgacttacgtgacttgattgatcttaagcaatctaaagctgataactaaagcaatcaaaaacggtttctcagatgatttgaagacacgtcatctgagaaaccgttatttgttatcggtaaattactgttttaacctggaatcttcctgagcacgcttttgatacattggaatttcgtcctcactggcacgaacccagtgatgcggcacaatttcaactaatgaacgttccttgccgtcaaattcctggctggcatcgtaaggaatttgaactcgggcccgttcatactctggatcgggtaccggcacagcggacaagaggctggctgtatagtcatgtagtggatgcgcataaatctcatcagaactggcaatttccagcattctgccatagtgcatgacaccaattcgatcggaaatgtacttaaccattgaaaggtcatgggcgataaacaggtaagtcaggttccgttcacgctgcaatttcttcagcaaattaaccacttgagcctgaatggaaacatccaaagcagaaatcggttcgtcggcaatgataaattgcggttgaacggcgagggctctggcaatcccgattcgttgtcgctgaccacctgaaaattcatgaggataacggctggagtggtctttgttcaaaccgacggtctccagcaaatcttcaacctgcttggaacggtcagcatcatctttggctaaatgattaatatcaattccttcagcgacaatatccttaactttcatccgggggttaagtgaggcatagggatcttgaaagatcatctgcatgtcccgacggaatgtttgcttttgcttcttggaattgagcttggaaacgtcctggccgtcaaagacaatcttcccggatgtcggttcatataaatggatgattgcccgcccggttgtcgttttaccagaaccggactcaccaaccagaccaaaggtttctccgcgatagacatcaaaagtaatgtcatcaacggcacgaacttcatttggcttaccaatgttgaagtattgttttaggtgttcaacctgtaatattttgttttcttctgaataatcaatcacagttgctcctcctgttcttcaacatgattccccttgctcttattaatttcttgatgaacaagttcggcgtagtgcttctggcgttcgatgattggttcaggtggcgtcactttgggtgcccgtttgtcgagtaaccaagttgccgcataatgggtatcagataccttgaaaaatggcggctgcttttcggtgtcaattttgagggcgtatttattccgcgcagcaaacgcatccccaactggtggatccaataaatcgggtggcgttcctggaattgatggtaactcagtcccgctggtgtccatggtcggcatcgagttcagcaagccccaagtgtacggatgctttggattatagaagatctcgtcaaccgttccgtattcgacaattttgccggcatacataacggccactcgatcagccatcccggcaaccactcccaaatcatgggtaatgaaaataattgaggtattggttttggcctgcaattctttcatcaaatccaagatctgagcttgaatcgttacatccaaggcagtcgttggctcatcagcaatcagaatttcaggatagttcaccaaggcaatggcaataacgattcgttgtctcatcccacctgaaaattggtgaggatagttgttaatccgctgttcggcattttcaatgccaaccagcttcatcatttccaaagcttgggcataagctttttcacgtttcatgcccttatgaataatcaaaggttcggcaatctgcttaccgattttcattgttgggtccaatgatgtcattggatcctggaaaatttcggcaatgtctcgaccacgaatctggtccatttgtttgcgggacttctttaacaaatcttggcccttaaacataattgttccgctgtcaatcacagcattgggcgagttcaatcccataatacttcttgtggtaaccgttttgcctgagccggattccccaacaatcgccagggtttcaccctttctcaaatcaaaactcacatctcgaatcgcttgaacagtaccggcataagtattgaagttgattttgagatttcttacctcaagaacatctttttcgttttccatctcaaaacacctactctctactctttggatcaagggcatcacgaagcccatcacccaagatattaaatgcaatcattaagactgaaagaacgatcgctggataccacatctgataaggcaggaactggaagttcttctgaccatcgttaatcaacgtaccaagtgatgcctgaggggcactgataccaattccgatgtatgacaggaaggcttcgaagaagattgcagttggaatggtaaacatcaagttaatgatgatcacactactcaagttaggcaataaatgcttaaaggcaatcttccaagaactttcacccaacgttcgggccgccaggataaattcctggttcttcagttccagcgtctgcgcccggaccagccgggccatgttaatccaactggtaatcgcaattgacaggataattgcggtcattcctggcttcaagaccaggattaacagaaccatcacaaccaggttaggaattgacagcatgatttcgatgattcgttgcatcaaggtatcaacccggccgccgatccaacctgaagtaatgccgtaaaccaccccaaatgccaaatcgaagaaactggcaatcaaagcaatttcaagggaaattcgcgttccatataagattcttgagaacaggtcacgaccaaggtaatccgttcctaaaatgtagaaatggttgccggcatgagcctgcgcataagcgttaacccgttggccggattgatcaatggttccgttaaacccgttaatatcaataccgggaatcttcggcggcaagttcgcgaagttcgggttggtcgcatttggattatgtgtttcaaataaaaatgagaagaaagctaaaataaagagaatgattaaaatcaccaaagcaatcattgctgctttattcttccgcaatcgacgccacgagtcttgtaagaaagttaaagatggcgttgcgattttttcgtcgtccagcttagcacgatcggcaccggcaatcggtgtaaaatcgtcagctgaagtttgttttgcattgtctgccattattattctccctcctacttattaattctgattcgtggatcaattaatccataaacaatatcagtaatcaacagcacaacacaaagcatcgcactatacacaattgtcagtcccatgatggttggataatcgttggtcaaaatcgacttaacgaattgttcaccgattccgggaatcgagaagatattttcaacaaccattgaaccggtcataatgttaacggccagcggtccaataatcgtgacaactggaattaaactgtttcgcagtgcgtggtggtaaataattccaactttgttgagtcccttggcctttgccagttcaatataatctgaactcaacacgtccaccatttctgtccgcatgaatcgggcggtttcggctaatggcgacgcggccagcgccaaggtcggcaggacggtatacataaacccgccccagtcggcgattgggaataatctcaatttcaaccccaggtagtactgcaagaggaccgccaaaacgaatgaaggaattgaaataaacagaatcgagatgatggtagctgaagtatcaacccaagtattggctttgatggcaccaacggcaccaacaaccaatcctgcaagaactcccagtaccattccttgaccaccaatgatcagagatggtccaagtcgactggaaattaagtatgaaaccggttggttactgaattggaaggaagtcccgaagttaccgtggatgatgccacccaggtaggccaggtattgctgccagacaggtttgtccaacccatactgtttataaatttgatgaatctgtgtcggtgtcaatttggcttggttagtcaatggagtaccaggcattaatttcatcaagaaaaaggtaatcgtactgacgataaacaaggtcagaataatgtagaatattcgttttcccaagtattttgccataagtgttcctctcatttctaattatgttgtaactattttttcataaaccccataataatgtaaaagaggccggatttcaataaccagcctcaaatacatcgaactgttcatttaataattacttaacgtaagccttggaccagtcgtattgtggtgaggtggtgaaggcttgaacacccttaacagatcccttaagcaaagcggcttgaccttgttgataaagtggaactaatccttgttggttcatcaagatcttttcagcttgaaccatatcgttccaacgagcggtttcgttgttggcatcggttgattctgacttcttgatcaaagcgtcgtattgcttgttagaccatttaccatcgttgtatgagttgttagatgtcatcaagtccaagaagttgcttggatctgggtaatcggcaatccatgcagaaagaccaatatcaaattgttgattttccatcttggttaattttgacttaaatggaatgtttgagttggtaatcttcaaaccaggtaatttggttaattgactttgaacaaattcagttgcccgtttggtatcatcatcatcggcacccattaaggtcaggctcaatgacttcttaccaacttgtttcaaaccttttgcgaataaggctttggcttctttcaagttgtaatcagtaccggctttgacatatgcctgatcggcaaagtccttgccgttgtgtttagccatacttgctggaacaaagcccttaggagcaatgtcgccaccttgcataactttgttaaccatttgcttcttgtcaattgctaatcccatcgctttacggatattgacgtttcgaagggctgggatcttcttagtgttgaattccatgtaagtagttgaagcttgtgggaagacaacgtaatctttgttgttcttgttgttggctgccaaagttccactcaaagtggtgaagtcaagcttgccgctgttgaaactgttcaatgaagttgaaggtgtcttaacagcttggaagttaacttggtcaagtttgaccttcttagcatcccagtacttagagttcttaacgagcttccaagtatcgttggttcctgaccagcccttcaagataaatggaccgttgtagctgttcttggttgaattggtaccataatcgctaccatatttggcaaccgtctttgaattctgtgggaagaattctggttgggtaaccatgaacttgaagtagctttgtggttgatcaagggtaacgacgaacttatagtcaccgtcagccttaacacccaacttggaaggtgacatttttcctgcgttgatcttagcagcgttcttgatgttggcaaatatgtaagcatattgtgaagccgtctttggcttaacggttctttgccaagcatagacgaaatcctttgcagtaaccggagtgccatcgttccacttggagtgacgcagattgaatgtccatgtcttcccatctttagaaacgttgtaactcttggcaacccctgggtctactttgttgtccttggccatgcgaagaagtccttcgttggtaccattggcaacttgtgctgaatacaggtcaatcatctttgaagtatccatggttgaaatggcggatggtgtcatccaactaacttcttgcttcttggttccttgtgaagatttacttccacacccagcaaggatcaggccagtaaccagcgctaccccaccgagtttcgctaatgaattaattttcatgttgcgatacttcccttctcatatatgaaatacttaatttgtaatgaccttattttaaattaaaatttgattaaaagcaaacactatctggtcattcaatcgatttgtccggtgccgaattggtatgggtggttaattgtgaacgtttaattgcttaaccaccagtgtttgaagattctctttcactttcaaaatttttaaaaatttattggtaaaaatgattctgtactagagatacgcaccaattaagtcagatatgcgctccaggcgcaaaccgattcacagcaggaatcaatcgcttactcactatattaagagaagtgtcaggtgtcgatatacatatttatatgcataaaaaagctcaccgcgaattgggtgagcttttctatgatattaaagtttatttaacagtaatcttggaccaatcccactgcggtgcagttgggaagaattgaacgccgtgaatctttggcttcatcaaagttgaaattgcgggttgataaagtggcacaatcccttgatcgttcatcaagactttttcagcttgaaccatgtcattccaacgagcactttcgttagcggcgtcagtgctttcggatttcttaacgagagcatcatacttggcgttgctccatttaccattgttgtaactgttcttggaagtcaagatatccaagaagttgcttgggtcaggataatcagcgttccaggcagtaatgaccagatcaaattggccactggcagaacgtgacagacgcgtcttataaggaacgttttggttggtgatcttaacacctggcaatttggtcaactgactttgaacaaattcggttgatcgtttggcaacgtcggtatcgtctgaaagtaacgtcaggttaaccgacttcttgccagtttccttcaaacctttagcccagtatttcttggcttcgttcaagtcgtaggccaccgcactcttcacgtatgactgatcggcaaagtccttaccgttacgttgtgacatgtcgtcggcaacgaatccctttggtgcctgtgaaccatcggcgagcactttgttggctaattgtttcttgtcgatggcaagtgagaaggctttacggatatttctattcttaaacattgggaacttcttctcgttcatttccaagtagtagattgaggcttgcttgtacaagtgatagttcttatcgttcttgtattgtttaacttgagttccgctcaaagtggtgaaatcaagcttgccgctttgataaccgttcaaggcggtgttaggatctttgattgcctgcatgtttaaggtatcaagcttaattgccttggcattccagtactttggattcttaacgagtttccaagtatcgttggttccgttccagcccttcaaaacgaaaggtccattgtagccgttcttttgagcatcagttccatatgaagacccatattttttaaccttcgaaatttcttcagggaaatagtaactctgagaaaccatgaatttgaagtaactttgtggcttgatcaaatgaacaaccagtttgtaatcaccctcggctttagcccccagcttggatggtgataatttaccggcgttaattttgtcggcattttcgatgttggtaaagatataagcatactgtgaagccgtcttgggattaacggtccgctgccatgagtacacgaagtccttggcagttaccggtgtcccatcattccatttcgagtgacggaggttaaacgtccaggtcttgccatccttggacacggtataattcttggcaacgccaggcacaactgcattgcccgttgtcatcttcaacagcccctcattagtcgcgttaacattttgactggaaatcaaatcagtcatcttcgagacatccatggtgttaatgttggcggctaccatccaattggcagattgtttcttggccccggaatcggaggatttgctgccacacccagctaacacaaccgcaatgagcagagaaacaccagcgatctttaaaagtgatttagtcctcataaatatgaaacttcccttctgtcttatgtattatctgtgaactcgttcattttaaattaaaatttaattaaaatcaatatcatttgaatattattataagactgatttgccggtattgttgtggaagtcaatgagatcaatgctatgggagatgaatttcagataataaaagttgcatatatttttaatctttgacaccggtcaatgatcagatccgaaaacgaagtgcactttgtccactatttatttacatttgtgtgttatacttgaacacataatttattaggaggcaccacatggatttacaagttactttaactcctgttgtcacgattggattgaaccgcaacaccagcagcttcgagtattcaatgactgaattgaataacttggcagaagctaacaatatgaaggttgttgaaaccttggttcaaaaattagaccggcccgatcctgccacttacttcggtaaaggcaagattgaagagttgacccaagtcgtcatcgatgagggtgttgataccattgtggtcaacgatgaactgtcgcccagccaaatccggaatattgagaaaaatacccattcccggatcattgaccgaaccggtttgatcctcgaaatctttgctaaccgggctcagtcccgcgaagccaaacttcaagttgaattagccaaattaaaatatcaactaccgcggctgcataccagtgccagccaacggttggatcaacagaccggtaccagtagtggtgctggtggcgcaaccaaccgtggtgccggtgaatcacaatacgaattgaaccggcggacactggaaaagcgaattacccacgtcaatcaagaactcaaagaaaccgccaaggctgatcagaccaagcgcaagcagcgtgaccgcagtgaaatgccaacagttgccctggtcggttacaccaacgctggtaagtcaacggtcatgaatggcatgatcaacttgtttggcgagaatgaagacaaacaggtcatggttaagaacatgttgtttgccaccttggacacttcagttcgaaaattaaccttaccagaccagaaacgtttcctattaagtgacaccgttgggttcgttagtcaactgccccaccaattagttcaagcattcaagtcaaccttgtcggaagctgccaatgcggacctgctgattcaagttgtcgactactctgatccccatcgtgaattgatgatgaagaccaccgaagataccctcagtgaaattggtgttaacggggtgccgatgatcgttgctctcaataaagccgacaagatggaggttgccttcccatcccgcgaaggcgacaacctgatcatgtctgccatggatgaaaagtcactgcaagaattagcgacgatgattaaagaaaagattttcaaaaactatcatcgattaacgttattaattccatttagtgacggtgacgttgtttcgtatttgaatgagaacacgaatattgaagccacccattaccgcgatgatggaacggtcattacagcggaattaaatgacgtagatgccaagcgatttgaaaagtacctattaactacggaataagttggttgttaacaacagcagattctgatactatttgttgcatatttttttgagaagaagagaggaaaaaccatgaaagaacagaaagaagtaacgctggaccgtgaccttggtctctggtcagcgttagcccttgtgattggaacgattattggtgccggtgtctttgttcgtcagtctgccgtcctagacgatgccggctcaacgtcaatggccctatttgcctggctggcaggggggattttaaccatcaccgccggattgacaattgctgaaattgcatctcaaatgcctgaaaccggtggtctctacgtttatatggaacggatctatggcaagttatggggctttctctccggctggatgcagattattatctacggcccggcaatgatcgcctcgcttggtgcatatctggccattttattatcagatttctttggcttcccaagcaagtacaatgccattctggcaattggcaccatcgtcttagttggtattttaaatttattctcgaaccgttacggtgcgacgtttgctattattacgacgatttgtaaattggttcctgttgccgcattaatcatctttggccttttctttggtaatgaaagtgcctttggtcaaagtttggttcacgtacatcaatctgccggcaactttggtgttgcgatcttggcaactctattcgccttcgatggctggattttggttgccaacctgggtggtgaaattaagaacccgcgtaagcttttgccacaggcgattacctttggtattttggctgtcttagcgatttacctgctggtctcttacggtgtttatcgttctgttcctgctgaacagattcatcgtttgggcaccagtgccattccatacatcgccaaccaggcctttggtgaagttggtggcaagatcttaagtattgggatcatcatctcaattgtcggctgtatgaatggtaagatcatgactttcccacggattatgtatgcgatggctaaacgtggtcaactgccattctcaaagacgctgtcctacttacacccaaagtcacacaccccaattttctcaacggttgccgagttattgatcgtcacagtgatgatcatcttctccaacgctgaccgcttgtcagaattatgtatcttcactgtatactgcttctatgtgatggcctttgtcggcgttttcctcttgcgaaaacgcaatccggatcaacatcgggtattctcaacaccattgttcccaatcaccccaatcctagcaatcggcggttccttgttcgtcatcgtcagtgaaatcatgtctgacctaccgggtgtcttaacatcatttatctttgtcgccgttggtattccggtattttattatgaaactaagaaataccgtgagagccaagcagctgcagcaaaagaagaatcattagataacgaaaactaataactcatacaaaaaacgagctggaaatcaaatttgatttccagctcgttttttgtagttgaggcaattttatggtaagacaacgaccttgccgaaactatcatgactatccaggtaggattgagcgtcggcggtatgtttcagatcaaacaccttggttggtgctacgtccacgtgattgttgttaatgatatcaaacaaatcatcaaacacccgttggtttagggcaccggattcaaaactggttaaataaccaccattgagttgggaaatgggctcgaagtgagttaagtcccaaatgccgccaagttcaccggtgacacaggtaatcccattttctttaatgaattgcatggagttgggcagcgtcaatgccccaaccagttctaagattcgatcaaattgtctcccggttgcctgcaattggttatcttgatccaagacaacttcatcaaagccgaccgatttcaattcatcggtcttttccagatgccgggtggagccgaccagcttgatcgatggcaccattgcccgcgctaatttaccggcagcaacccctacaccactggttgcaccacgaatgagcagtgaatctgcttcgtcgaggtgcagtttgagcagtgatccgtaggctgtcccataagtctctggaacggctgccaaatcttgaatcgcaaggtgagtgttaaccgcataaatatggtcatttggcagcaacgtatattccgcataactgccgtcaaaagcacggcccatgccacccattacagaaaccacaatttgccccttcttcaagcgctttggatcggtggtttcaaccacttcgccgacacactcaatgcccaggattcttggtaacttgacagatggtgaccaaccatttctggtaaaaatttctgaacggttgatcccaaaacctttaactttcaatagcgtccaaccgtctttgactttgggcgtcggcacatcttcataggataaggcggaaggtccacccgggtgacgtaatacaattgctttcattctaattgccccctaaacactctgtcgttcgacaattttaattggcgtatacattgaataaaattctttaaatgagtcactcaccagcatatccattccgttagcccccatctcgaaaaaggattgggtaacactggataatttaggccgaacgatgtcacacaattgggtgccgtcaatcgtcaagattgccagccggtccggcaccttcatcccatagttggtggcttgattcaaaattccaatgcctgccagatcacttgaagaaatcacggcagtcaactcggtttgcggaccataatgttccatggcgttcacaccatcttcataggtaaaatgccccccgcaaatccaatcctcatcaaatgacaaatggttgtcacgcatggcatcccggtagccttcatagcgcaaatgaccgacaaatgaatccaagtcggttgcggcaagcccgattttttgatgacctttgccaatgagatacttggtggcctgataaccaatatcaaagtcattcgaagaaatgaatggaaaggcactattcttcaacgtcatcgaaataaaaataaatgggatattggcattttccagcaactcatcatttgaagggtccaaatcaatcgccactagtaaaatccccatcactgatcgttcaatgacggttcggatcgcttttgcctggacctcggcatcgccttcaccggcgaaaataatcatgacgctcaggttatgaacccgcgcctgttcttggatcccctttaagatctgatcagagaaattggtttgagtagaactgaccagaaccgcaatcaccttgctgcgttgcgtgaccagttccactgcactggtgttgcgccgataacccagttgcttaactgccgcccgtactttttgagctgttttttctgaataaaaggctttttgattggacaaaactcgggagaccgtcgccggagaaaccccggcagcccgggcaacatctttaattgtcgcagccctgtgttcacctcttcatcaatatagtcggataaatcttcgaaactaattataccacagggccgattaaccatttctgcctcaaacgtttgtgttaggataggtttacgtatttgaataagcacctaggctcaaaggcaaccatttccggttgtcttttttggtgtccaataagcttggcgttataattaaggaaattgttctgtaaaggagggctgcccatgaccgcttatgttttgtaccaactcgaatggattttaaggctatttgtggccgcaatttgtggtggcctcgtcggttatgagcggaaggtgcggttaaagaccgctgggattcgaacccatatgttagtggcggttggatctgcgctgttcatgatcatttcgaaatatggtttctttgatgtcatcaaccatgcggatgtcagcttggacccttctcgaattgcctcgcaggttgttactggaattggttttattggcgccggggcaatcattacccgaaatcacaagattgacgggttaaccaccgcggccggtctgtgggcgaccgctgcaattggcctggcaattggggctgacatgtatgttatcggcattgctgggacgttgtgcatcctagttacccagaccatcgtccgtcagattcgggcattcaaacgataccctaaccgttccttacttcgcctgcaagtgacttttaacggcgaactggcctcgatggatgagctgccgggccgcctgcgagcgatcggcagtgctgatatccgaatgagaatcgtcgcttacaaaccggattcgttctcactggaagtccgggtaaaattgcagcataaaatggatccggacgagtttatccgccaaatgagtgatttggtcgatgtacggaagattgaagtgctggattaaattccgaatataaatacaacactcagcgtaaagccgccagtaaggcttcttttttggacgggagaatggctttatgttatctttacaggaaagcattagtgaccaagtattggagcccttggttcatcagagggtacgaaagttcagggtctgattgaaatatacgaaaggagtaactcaaattcgaagaatttaaataaatataagcaacacatcataaaaaagacatcgcactaaccgaaattagttcgatgcctatattaatggcggtatttgtatcgccatcaccaataaccacattgtaaccgcattcttcgaaaaaatctagggttctgctcactttgtatatcaaaatttaggttagagtcagacctatcattaaaaacagaggcaaggtctcctaagggagtagccctatacatcccgcgaatactatatttccaaagtgggtttaataatttttcatcaatccatttaacttttcgtagattctcatacatctttggacttaataattcgattgatttaaccaatttttggaattcaggaagttttcttttatcctcataattattattttcaagatttaaaattttttcaaattcaggaaaactattcaacggaaatttatttatcctgccgaaaataatacttgatattaaatttgttttcataattgttcatctctttaacgttttcaaattgcatcgactatttttttgttttttaacactttttttgttaaccagtcagtctccaccgaatcgcgatgggagatcataaatatacccataggtaactgactaagaactcttaaaaaatctttttcgctcgtttgatccaaattagctgtgggctcatctaaaactatcagtggacgtttcgctaacaacgcacgtgcaagcccaattttttgaagttgccccgcagataagttcatattatctcctccaaaaatttgtgtctcaagtttattcggaagacagtcaatcagagatctcaaaccaaccttttgtataactgtgcttaattctgcttcaggtaattttcttcccaataacaagttatttctaacagtgtcggaaaaaatttccgtttcttgtggcacgtaagagactaaactgataggattaaccttctgttcaatattttcatcaatcccaatcccgctaatttttcctgaattcggttcatatagtcccatcaggagttttataactgttgtcttaccagcaccactctcacctacaagtaaaattttttgtctattttttaaattaatgaaaatacttgcatcttttaaaacccaatcttcatttttaggataacgaaaagatacccgttgtaatccaaatgaatttacactatgcaaattattattatcgattggcttaatctgatcactagctaaaaacttcactactcgtttcaatgaagctttttgacgagcccagttagcatacaatccaggcaactgataaaatgcccaagtaaaattcgcattcagtacattaaaacccataaattgtcccagtgtcagtgcatgaacactaattaagtaaatgctaaaaactaacggcgtaacatcgaaaataaatcctgcagcaagacttatactattcattcgccattgactttttgcatttattaattgatcccctgtatatctctgatacttttctttgaaaagatttagaccgaacctttcagcaaaaaatgagcgcagaaggctcttcccgccaaaaacttgtaacattatctcttgcatatcttctctgctatgttgcgtattctcttgtgtcaccgttattaatttcccggttaatcttggtatcgccatggaaaaaaaactcagaatgagtataaaacaagttaacatccacgatgataagaatccaaaaactatagcagacaaaaatgaactcaaaccaatcaaaaggtttgtaaacgtttctggtactactcccgatagtaagggaacatcagaattgagaatcgtaatccatccaccttttcccattttttcaacacttatagttttcttgacaaacacattttttattaggttgttagacaaatcaaattcaattttctgtttgagcctcccctgctgactcacagtgaaaagtttgcatattccaattactaaactaaggccaattaagtaaattgcactcttccaaaattggtcaacttgtttttcacttaaataattcatcaggatatttagtttataagctaaaaaaactcagaaatagctcccattatgccgacaatccataaaggaacaaaaaatttgttcttaaaaagtgaaattaaatatttcttttcttttactttcatgttagccctcctattctgataacattgtctgagggttcgattaaatcaaaagtatgcgtgataattaaaataccggtttgtttagaaattgaacgcagctcttgcatcaatgctgtctgattctctctatctaaatcggaaaatggttcatccattaccacgaactgtttgttcgacagtacagcccgtgcaattgaaagccgtcgcatttgaccttctgaaaaattagtttcgtcaccaacgacagtatttaacccatttgaaagttgttcaatttgatgactcatatgaactgcttcaagcacattctttattgtgctcagatcaattggtttatcaagagtgagattgcgataaatggttgtattaaaaagaatatttttttgtggtacataagctagtttcaaactaaaaccagtttgttcacggttattagtatccaatgcaaaaatccttccactcgtaggttcaatcaatcccaaaataagttttattatggtagtttttccagctccgttatctccaacaataaatgtgatcttagatctcggtatggtaagatttaaatttttaaatatttcttctccatcatcggcgtaactaaagtacaaatttctaatcaaaattttttcgagattcattgcttgatcggcctttgatccaataacattgtggtcttcctggtaaaccgacattcggttgttgactcttttgattgctacatgttgttgagataaatacgaaatcacaccaggcagcgacatgaatggatctaaaattgaaccaataccagcattccaaattccaaccattacactgagttgcagattattgtttttcactaataataatcccccaataagcgaactaacctcaacaaaataaaccccacctacaaataaactactgttaatagctgcagtgttgacatttttcgtccaatatgggaactttttcgcgaagaaatactgatgcttagtaagtgcccattgtgtgctcccgaaaattctaagcaatggtatattcttatataactcagcaaaaaaacgtttatgttcgtcatcatagttttcgaatatttgacgcacatgcgcttgtttttcaaaaaaataacgtactaatacaaaaaaagttaacccaatacataaataaaatacgccggatatccacgaataaaagaaaacatagcacaatcccattagcattgacaaaaagaaatcaaacagcggtgaaacccctgaatataagtaatttgctattgtttcggcatcctggttaattaaattaactagttcgccttccctaacttcttgcctctgactagaacttattacattattcataagttttaaactcaccgtctcgctaacgtgctttttggttttttccaataacatagaataattaaaataaataattccataaacaacggatcctgcaattagtgctgcccaaacataccataactgaaaaatatttttcccaaaagctatagtaattccaacttgaatcattattgacacaaataaattaaagccgctcatgtataatttgcttagaactaaccacaggtacctgttttggggaaccaacttaaaaatttcgcgtatattcataaaatcgccttcttccgctccatatcaaaatttcaaatatgatcctgttttctcaatccaaactttgttcctcaactctttaatatctcctagaactataaattctaatattttgtcaaaaagctcggctgttagagaataaataccgtgtactatttattttaggttaacgcttaaaagaagaataccaccatgaatattatttgtaaatgattagaatattaattctattatcattttaaacacaaaaattaaaggttgaaagctacgtattgaagcaagagactgggaaaaaaactagtctgtaatcataaataaggaatctgttcccattatgtattagcgaccaaactataaaaaaagaagtggcttccgtgtacagaaattcccgatttaaataaatatagggttctgctcatctttttggacggctcagcaagccagaaagtgaatgctaagcacgattccgcgggattgcgatcccgtctccgtcacttcgccttgtttgtttccgctgaactttaggacggctcagagtagcagaaagcagagaataaccatgactaccgtaggattacgatcccactaacgtcacggttattctctgctttctatcgctactcttcgcccacttttgaactaaaacacttacatttttccgaaataatgatatgatattcataagaacccatgagaatggaaggtgagtaacatgttacaacaatataaaaacattttagctccaattgatggatcaaaagttacagacaccgtcttgaaaaaggccattgaggtcgccaaacgcaatgacacccatcttgacatcctaaacgtacttgaagtcaatcaattcagtgatacctatggcggtgccgtcagcggtgacgtcatctacaaactctctgaagacgttcaaaaacgcttagccgaactaaagaaacaagccgaagatgctggcctctcagacgtcagtgtccacgttcgttttggtaatcctaaacccgttattgcaactgagtttcccaaagatcaccacaacgaacttatcatgatcggttcaactggtttaaacgcattagaaaggttaatggtcggctctgtagcaacctacgtcagtcgtaacgccatttgcgatgtgttagttgtcaaaccggagtcaaaataaacactaatccttaaattcaaaaggccagccaaacaattcatttgtttgggcctttttgttatggagtgagacatcatgaattggcaatatcaacgcgttcttccacctagttttaaaaccacatctatccgaaacttattgcaacacaattgggcactttcacgaaaagaagtgcattttttgcgtatcaatcgttcgatccttataaatggtcactatcaatcaatcaacactgccgtcaaggctggcgatcaagtcaatctcagttttgattcggcaaacttttcgaccccaattccaagctttttaccagacagtgccgcaaatttagatattttgtttgaaacagaggatcttatcattgccaacaaagccaatggggttaaaacgcattcaaaccaaccaaatgaaattggcagtctgatgaaccatttagctgctcatttaaagggcactccttttcatccttacaatgtgcatcgtttggatcaacaaaccagtggtgctattctagtagtcaagaatcccgttttaattcctatttacaatcgattaatcaaaaccaaacaggtccatcgaacctaccttgcggttgttcagggccagttttcagtccccaacggtgaaatctccctgccaattggcgaaaccctttttgacaaacgtcagcgcgtggtaaatggcaccaatgccgcgatggctaaaaccagttatcacgtaatccaaatgtcagctcatcattcgctcgtggaaattcaattacatacgggtcgcacacatcaaattcgggtgcattttgccagtttgggccatcccgtcgttggcgatcctttgtataatcccgaatatcactccgggcagcgtttagccttacattcgtggaaaatcagctttccgttgccgttttctagcgaagtaaaaacaattactgcaccgattccagaacattttcaactaaaaaataatcctactagaaagaagtttgataattttgacaactaacgaaaccttacatttattaacccaccatcggtcaattcgccgttttaaaaaccagtctttagatcgtgacaccattcaaaccttgttaactgctgctcaacgaacatcttcaagtatgttcatgcaacaattcagcgtgattagcgtcaccgatcctcaattaaaacagcaatttgccgaaattactacctatccatttacacaaagtaacggccatttattcattatgattgccgatcaacatcgcaatgaatttattggagaagaggcacatgaaaataccaaattactccatgatggtgatcgcagtttggccgcttttgacgacgctgcgttggctggccaaagcattgtaactgctgccgaaagtatgggacttggagccgtaatccttggcagcatattaaatgacgcccaacaagtaattgatcttcttcacttacccaaactaacttttcccgtctttggaatcgctgttggctaccctgatgagaagccaaatttgaaaccccgcttgccacttgaaagtgtccattttgaaaaccattatcaagaaccagataaacaaacattagatgcctatgatcaaactattcagtcttattatacacatcgcgattcaaacactcgtaatgagaccttcagacatcatatcattcatgacatgcaagtaagtcctaagaaacgttccgaaattctatctattttgaaaaaccaaggtttttttgaaaattaatcaacaagaaaaagcggacagagtttacaactaactcttcgtccgctttttctagttatccaactttttgccataatactttttttcagcttctctacgtgctgctacagcatcttcaaagtgtttaaacgtttttgataacacatatttataatcaatcattaaatgggcgtaccacgaatcagactgtttgtcataagacacaccaatcacgccactcttatttcgtttcgtaaacttactagatgtaaaactaatgccatctttatttactaaattagtggctttacccacattcttttgaaacgccggattacacttactactttgtttagaaatttcacgcttcaaacagccacaacttttagtttgcccacagcgcaatgaatatccatccacaaccactttattaccacattcacactgacacaaccaccttacattgccattggccggattacttcctgcccgctgtacaaccaataatcgtccaaatttcttccctaccatcggtaccacctgatcaccgtccaaccatcgttttaatcttgattatttaattttttctattaacaatacgccatgctatcatttcggcgttcaatatttacgcccatattataataaattcttataaaatattcagctaatacttatagttggtgcatattattcaaatctttattatttttatcgcaaaaaagccttggttaatttatcaccaagacttttgttgcgcataattcaagtttttgtcaaaacaatatctaacttttagtctaagggtctccaagtccaatccttaacttcaggaagatcatcaccattatcacgaatataattataatgttcgaccaacttgttatccattttctgaataaagtcggctcccttttctgcatattcagggacatctgtaatggcttccttagctaaatcaaagcgatctagttggttaaccacccgcatgtcgaatggggttgtaatgtcaccatcttcacgataaccgtgcacatgaatgttgtgattatggcgatcaaagaaaatggacttgatcaaatcttcgtaaccatggaaagcaaagattacaggagtatctttggtaaagtagtgatcaaattcttcatcagacaatccacgtgaattgactttcggactttgtaacttgagtaagtcgatcacattaataaatcgaatcttcaagtctgggaaattgtcatgcaaaatgttaattgctgccaagctttccatgttaggctctgtacccgcagccgcaaagataatatctggctttgtgccttgatcagtacttgcccaatcaataattcctaaaccatttttagcaagcacttctgcttcctcaatggaataaaactgtggtcgtggttgtttagatgtgaccaaaacattgaccttttctcgatcattcataattaatgggctaactgccaataacgaattggcatcagctggtaggtattcacgaatgaatgcaggtttcttttcagccatgtgggtcaaaattcctggatcttgatgggtataaccattatgatcctgttggaaactcgtggaagttgaaacaacattcaaagatggataatcttttcgccatttcaactcactagccttacgtaaccacttgaaatgctgtgttaacatggaatccacaactcttaagaatgcctcataacttgtaaagattccgtgccgtccagtcaacgtgtagccttcgagccaaccttcagcttgatgttcagagagttgggcatccaaaattcgaccagcaggagcaagatcttcatcccaatccttcttaattggatcgatccactgacgatttgtggtttcaaacaagccataaaggcggtttgacatcgtttcatctggaccaaacatccgaaagttttcaggatttaacttaatgacatcacgaagataatctgaccaaacaatcatatcttgtttgacattttgaccccgtttagtcgtgtcaaccgcataattacgataatctggcaaacgtaaatcatgtggcttaacgccaccattcgtaattggattggcagccattcgtttatcaccctttggtgcaatagcggcgatttctggtttgagtttgccgttctcatcaaatagttcttcaggtttataagatttcaaccaatctaccagtgcatcggaatgttgcatgtcggcttgatcaacaggaattggaatctggtgagcacggaacgtaccttcaataaccgcgccatcccaagtcttaggaccagtccagccctttggtgaacggaaaataattactggccaatttggcagcgttggatcgttattttcacgcgcatgtttttgaatagccaaaatttgttctacagctgagtccattgccttggccatttctaaattcaatttttcgattccttgatctttaacctcaacgaaaataggattccagtttaggccttcaaagtactgcttaattttttcatcagacatccggctaaacaacgttgggttacttaatttatagccattaatatccagaatcggtaaaacagccccatcattaatgggattaataaatttgtttgattgccatgaagttgctaatgggccagtttcagcctcaccatcaccaacaacaaccgccgcaatttggtcaggattatctaaaattgctcctgttccatgagaaagcgaatagccaagctcgccaccttcatgaatagaaccaggagtaacaggagcggcatgagaagccacaccacctggccatgaaaactgtttaaacagtttcttcataccggcttcatcctctgtaatttcaggataaacctcagtgtaactaccatctaaataagagttagaaaccattacttggccaccatgacctggtccctcaacgtaaaacatgtttaagttatatttattaatgactcggtttaaatgggcatagagataattttgtccagaaattgtgccccaatgtccaattggatgaacttttacatcatccttttttaacggacgtttaagtaagggattgtcttttaaataaagttgccccactgacagataatttgctgcacgccaaaatttatctagattttcaaaatatgattttgatgaataatcaacagccattgtagtgctcctttcaaacgttaacttttaagttttgttatcgaatacatcactataataacccgatttatcgtgatggtcaactaatttgaaaattgatacggtccaattttaaaaattatgctttgtatttgtaagcatcatttttagattagaaaacaggctgacacgctgtgggtacatttttaaacctttccgaatctatataaactaccgcctcatttgaattctattttaaccgaaaaaaagattaatcacatctattgtgattaatcagcaagtgtcaattcttcaatttttacataacttgtttatttcagttccactaacgcattatatttcatatatttgtagtgcaaacgcatatttgatagttcaaacggtgttccatcatctaagaaaaagatgcctgacatcactcccactggctcattagaacttaaattcagaagttcttggtcctcttttgtagacggttgcgcctcaatcgacaaaaatgattttgtgactgtctgattctttttatcctctaaataattaaaaatggaacccgagacaattgttcgtgataactccggtacaatcttaatcggaatatatcctgtttcaatcatcactggttggtcgtccaaaagccgtaaacggcgaattcggtacacaaaatcctctgaagctaaaaagagatccgtttgcatttctttagtagctggaatgacggaaaagtccaatacttttatgcctggcctcttgccatttgcacgcatactgtcagtcacacccaaattggaaccctcatagttaaacaaggaccgatttttcagataaagtggattcacaaatgtaccagaaccacgttttttaaacacgatcccttcatttgcaagaacgttcaaagcccgtttgatggagcttcgactcacgccatactgactggtaagggttcgctcatctggcaatttctttgccgggaactcgttatcgaagattcgtttttccaaatcttttaaaattgttttgtacaccaaatcagccaacacgcgccacctctttaacttatcgtttatttatactttagattatagcatatccacgtctcttactgacttatgctaaaatgaaatctaggaaggtgaacatcatttctaaaaaaaataagaaaaataaaattgataaaacactcgttgaaaaaattctagacaaagctaatatgaagtatgaacaaatcatttttcccaccaagcaagaaggcgacgttgaacagcttcaggttgaccatcttaaagaagacgaacatcgcatttataaaacccttgctttaactggtaataagactggtccgttggttggcgttctaccaattgatgaacatcttagttataaaaaacttgcaaaagcatctggtaataaaaaagttggcatgattccgcttaaagaattggtcaaaacaaccggatacgaacacggtgcaaataccccgatcggtatttacgaaaccaaacatttcccaatctatatttctgatattgcccaaaaacagggtgaaattattgtttcttcaggaaaaattggtcgctcgatcaaaattgacgcaaacgatctaaaaaaattagtccacgcaactttttctgatttaacagaataacaaaaacagaccaaatgactcgctcatttgatctgtttttcaattgtcttcgtccagtcattcaaagaatttacaacgacgtttcgttgttccgcgctcccaaacaactgacaagtagcttcgtccatctttgccaaacaggcatgggaaattttaaccatcgctttaccagattccgtcaatgataatgtgacttttcgccaatcatatcgctttttgataacgccttttttcactaaagtgtctacaaatcgcgacattgtggatggcgagtaacccatctgatcggccagctcgtgtaataacactgttttctgctcatcgatcgccattaatacgtagctatatgtgggattcatccccgttggttcataaatttttttggcaattttttcggtatctcttgctaaccgatttgagacaaagtacgtacaattttttaaaactgatgtcattttattcctcctcaaacagatccgttgacaaaaagtataacagacatttactatgtatgtacagtgatatgcatatacacatcaataggaggatttaaaatgattacagcaaaaaacgtttttattgggtttggtaaagcagccaaaacacttgccggagctctagcagcccacggcgaatccgttattatgattgaagtttcagataaaatgtatggtggaacctgcattaacgttgcttgtattcccactaaaacgttattgacaagttcccagaacaaccaattaggaaatgcgcaaaaaaactatttgaatgccattattaacaaaaatgacgttaccggcactttgcgtgaaagtaatcttcataagatttctgacaaatcaaccgtgactgttttaaatgggcgtgcagaatttgaaagtgctacccaacttaaagtcacttacaaaaatggcaaaacagatgaaatctctggcgaacgcatttttatcaatacaggtagcaccccaattttaccgaatattccagggcttcaagaaagcaaattcgtcaaaactagtgaaagtttaatggaccagcggcgtttaccaacccatctcgccataattggtggcggttatattggactagaattcgcatcgatttatgccaacttcggatctaaagtcacaattttagatgccggtgataagtttatgccccgtgatgaacgggaattggccacagaagttaaacaaaacttggctaaaaaagatgttcagtttgagttcaatgccaaaattgaccaaattgaagatcatgctggtggggctcgcatcagtttcactcaaaatggtcaagcacgccagctctcagtggacacaattttagttgcaactggccgtcgagcaaacattgatcacttgggactagacagagctggtgtcgaaaccaaccaccgtggcgttgtggtaaatgaacaccttcaaaccaatatcaaaaacatctgggcaatgggtgatgtccgcggcggtgcgcagttcacttatatttcactagatgattatcgcatcgtgcttgaccaattagttggcgaaggcaaacgtactttagcggaacaagaattagttcctcatgttgtctttttggatactccagttgcgacaattgggttgaacgaagaacaagctaaggcccaaaatgtgtcctataaagtcggaaaaattgcggcagcttctgttcccaagactcatgttttaggaaacacaaccggatatttaaaggtcctagtttcgcctgactctcacgaaattttaggtgcaacattatattgtgaagattcacaagaactgatcaacaccatttcattagcaatgcatcaacatattcattacgaagtgctacgagatcaaatctactctcatccaaccatgacggaagcgtttaacgatttatttagtgcaattaagtaactgataattcgaaaattatcataaagttttcgttttattccgtaaaaaaaattagcatcatcttcttgaagccaggcctatcttggcttgggatcttcaaaagggtgatcctaatctttttttagaaaatttacttattcttgattctttaaaactgattgccagctcttcattgcgttttcttctgaataacggtcgccaatttcgtatgctttttcactgtatttttctaagacatctggatcacttaacaaatcaatgatagctcgactgaacaagaactcatccacatcgtcttcttcaatcaaccgaccgttttctttatctttgatgatctcacttggtccataattactgttaatagctaccgctggaagcccatgtgacatggcttcaatcatcgccagtggcatggcatctgacccgcttgcgctgacaaagagttcggcttgattatagactgggctcaaatcataaacaaacccgcggaaattcacttgtttgtctacttttaaatcttgtgccaacttcttcaagccatccacatcttgaggactgccataaccataaaggtccaacgtcacgttcggaattttattgcttacaatcgctaaactccgaattaaacggtcaattcgtttttctgaggataaccggccaacgtacagtaagcaatcagccacacgacttctgtgggccacatgtgcttcattacgtgttgcatttaaaacggttgttcccggaataacataaattggggtttgtgtatgatttaatttttgcgccaaatcctttttttgtgcttccgtcatcacaataataccatctaattcgccaattcgagcccaaaacactggttcatatgatggatcaaatgcactacgaacgggttcttgtggattaacggcgtgtacaattggcaatgatacgtatttgtgtgccagtgtcaccatgttcaacatcggcaaattggtttgtgctgggcgatcggcaataaaagtttgatgactgccacttcttcgatttaattcatctaagaaaaatgtaaatagttcatcgagattatcaaaattataatcttcacccttataatcaatcaacttcaataatgaatttacaggatttccattggcatcattcatatagtaggactcgtaaacccgtttgccttctggtgtaaacataaattcagcaacagcattacccgttggcccaaagtatttgtccatcgatttgaatccacgccaatcataaaactcggttttggcagtatggccatacgcatcataataattgatgtgagaaacttgcccaaaagtaccactggcaaagtagatatccccgacgactcggtcgccatcgtacacacgactaaaatcagcgccctgatcaatttcgtaatctttgggaagattcaaatcaacagttttaagtgtctttggcttttcaatatgttccgcattttggaaaaagtcaaacatattcacaacgtcagcgtctgctaatcctagtgtatccatgtttcgatgcaactcttgattataatctcgcgtcacaatcttggcatccacatgattattattgaaaaggcgaattcggctaatttcggtgtattcaacgccggaatttaagcccattaaatattcatttaaaaagtaaatcatctacttcgcctccccattttttaaatcttcgctaaagaaacgatctgcatcagtaattaattgttgccatgctttccagatcgccttttcactgaaacgttcacgactaacataggcattatcactatacttttgtaacgtatcctgattctccataagggcaatcaatgccttcgcaaacgccttgtagtcgccatctttaactaattttccgctaaaatcatcctcaataatatcagaaggcccatacggaatgtcataggcaacaactggtaatccatgtgattgagcctccaaaacggcaagagcaaagccttcaacccgactggtcaaaaccgagacctgagctttatccatgatttcaccaatattaggtgtgtatcctttaaactgaaccgcatcatccaatttcagctctttaacttgttgttccagtgctttatctgtttttccgtcaccatagccccagaaatcaagtgtcgtttgtggcaacttcttatgcacaattgcaaacgccttgaccaaatgatctaaacgcttttctgggaaaagacgcgcaacaacaataattttacccaacgtccgatccgtaaaacgaaccttatcttttttcatcagttcgttgggcacaatcccaaccggaatcgtaaatattggtgtgcgtttagcatcaaaacgtaatttggcatctgcagtttgacgatgggtggaatccaccaccgcattccaatcgtaaaaattatccagtgagaactcaaaattattgttcaacacggggtccattgggttgttcggatctgcagtgtgcgcattatgtagaaataagactttatatgccttagtcttcatgtgtaacaacgcccactcagtttcaactgcccgatcagaaataaagatattatggccatcatcaaccttattgagttgatcaaagaagaaccgttgtagaccctttaaccctgtaaattcataatcttggccgtgaaaatcaactacccgtagcaaggagttttgaactttcccttgcccatcattaaagtagaaagattcgtatacaagtttgccttcgggagaaaaaatctgttcactgcttaccccaccttgcgggttgtgaatttcagcaattgacttaaacccacggtgatcatatctttcccgtcgtaaaaggttgccggcataatcaaagtaagtgaccacttgaacctgtgcgtcatgatcactccatggctcaatccgaacagcgattcttccttttaaatccttggccgtatatgttgccgcacctttatctccacgtagcttacaaccatgaggtaatttaacgtctttagctgtgaatttgcgcggcttaaaatccccagatccctgcaaaaattcaaataaattaatatgattttcttcagaaattccggcaacttctaaattatgatgtaaatccacttcaaaatttcgtgtaacaattttgtttgcaacaccactatcgttaaataaatttactcgtttaatttgagcatgttcgataccagatttatttaaaggaattgttgtatttaaaaagtaatacataaaatcccacctttttaatttaatatgagtttctaattcgattataacagaaagcgttatccatttatcgctgttcaaaaaaatagcgcccgttttataccgaaattagcttttcagcaaaacagacgttatttttaaacaaacttttttagaaatctaaactttcatgacgtaattttggtaaacgttttgcaactgtcttaatattcaatagatcccagtcttccaagttatgagaaatagagttcttgccccatgatccacagcccaatgttaaagaaggtgtgatgttattgtatttgtaaccaattgcaccttgagaagttggtgtattgattaaaattcggcaggcatccatctgtaaagcaaacttggtaattagctcgtcgtcttcagtatgcaagccaacagtatgacctaagccaccaagatttagtccccgtttcattaaatgaatggcatcatcttgattagttgctttaaccattgtcaaaactggtgataacttttcatgagaaagaatgtaatcaccaccaagactaggcatttcggcgacaaggaatttggcatcttctggacaatcctcaatgccagaccactgagcaattgcataggctgattgaccagcaaccttcgggttaacagattctttttcacgattcataacagttgactcaaagttttccatatcagcaggctttacaaaataagcaccacgctctttcaaaccttttttgacatcatcataaatgtcagcgtcaactaccatattggattcagatgcacaaatcatcccgttatcaaacgacttagacaaaacaatgtcatccagtgattgtttgaggttagcagatttttctacgtatactggtacattaccaggaccaacacctaaagccggtttacctgttgaataagctgacttaaccatcccggcaccaccagttgcgacaaccgtggcgatcccatcatggttcattaaatcagtggtagcagccatacttggttttgtaatccactgaacacagtcttcgggagctccagcttttacagcagcttcagcaatgactttaccagtttcaacacatgtcttttgagcaaatgggtgaaaagcaaatacgattgggtttcgtgttttaattgccaacaaagcattgtgaaatacagttgaacttggatttgtaacaggtgtggcactcgcaattacaccaaccggctcagcaattttcataagaccagtttctttatcatccataatgataccaaccgtacgatcatttttaattgaattataaatatctttagttgcgaattggttcttaataactttatcctcataaaccccacgaccagtttcatcaaccgccatttttgcaagcttttgacgagcatggtagccagcttctgccattgcgtgcacaatcttgtcaatttgttcttgatccatgacactgagacgatctaaagcaatatgagctttcttaacaagttcattgaccattacttgtggttcatcaatttccttcttgttatccaaatctttaatcatattatattattcttcctctcagaatgagtatgttattcgcttcacaattataattgtatctttctaatattcttttgtaaatgccaattgtttacataatctaaaattgatagaaatcattgtttcctatgctatcaaaggatttggactttgtgaataattcatctcttcaaaatgactgatattaatattgtttgtgaaattaagcacaaaaagtaatcgcttacttcacaaactttctaaaaattggtagaactgttacctttatgggaggtatttagttatgaaatggaacggtccaattgtgggaattaattgtcttttttaggacagtttttcaagtcagcaattagaagataaacaagcttccagcgggattgcgatcccgcctccatcttgcttattttctaattgctcccgacttgtgccactcacttttttaggacagttcctcaagtcagcaactagaagataaacaagcttccagtgggatcgcgatcccgcctccatctcgcttatcttctaattgctcccgacttgtgccactcacttttttaggacagctcctcaagtcagcaactagaagataaacaagcttccagcgggattacgatcccgccttcatctcgcttatcttctaattgctcccgacttgtgccactcacttttttaggacagctcggcaaaacaagagggagaatataagcatgcctactgcggggatttcccccgcttacggcacatttatattctccctcttatcgttttgcctcgctcactttaatttagtcggcttatgctccactgacttttgcaacaagcggatcaactcacccgtttgcacctgatccacaatcatattcgatgtcacctgcatcaactgttccgccaaattcttcgcaaccgtcgtcgtatgctccatcccgattcgtgcaatcttctgattcacaatatcaataaaccgatcatatgcctgctttggataatccgtcgccgttattcggtcaatccccgatctaatcaccactatcggaaacgactgcttcaacaacgtaatcaacaaaatatccgctacctgcatcacctgatattttttcttagtcggtgctaccaccgctttttgcttcacataattattaatcatcgttggcgttaccggatccattcccaatggtcctgtatatcccgttaacaacgccactacctggtccatatacaaatcaaaatttggcaactcatcccaatgtggaagtctaacttctcttactgttttcaaccaatgattatacgattctaattcactcatttcattcaccccgtccatagatgttagcttcattatatcatgatcatctagtttttagaactagattgaccgttcatatcctattttcgtgacgaatcgggtaaaaatgtgctattcttaaaaaaatacttatgaattgaggcacttattttgtttgaatttacaaaaaaacgacgtgtagcagatgaagttaaagaaatcattccccaaccagtaatcgatggcatctggaaaactctgaaacaaatgaaaactgataaacttatagtttctccagttattgcatttgtgtttagcgatgactataccgaggatacaatttatgtcatgggtctccaaaattccggtgctgtagccaaagaatatgacattgcctacagtggcgaaaagaagtttcttggccaaggtaccatcattgtcgtcaaagataagccaaagacgctatcgatgagcatcagcgaactaaacaagcaatcaaaggagtaatccaagatcttgaaaaatcttaaaaaaattactttaattattgctttaggccttttgagcgtcaatttagttgcctgtggtaaccaaacaaattcacgttctaccaaagaaaaagtaactagttcaaaaaaagcccaatcttcttcaaaaaaggtcatcaaaaaaacagcatctttaactggtcaaaaattccagacgccacaaggtttgtttgtaattacagaaaatcatgtgacagcttcagccaccgccgggaaaaaagttttgattttacgatatacttttactaattctagtaaatctcaattagttccttcagattattggtataaatacctcaaagccacacaaacagtcaatggtaagaccaaaaagcttgtccaaggctcattaccattttcaaccagtacaactaaggatgactcacttgaaaattcttcagtcaacgaagtcaagtcaggtaaaacacttaatgcagaaggctcatgggaactcgcaaaaaacggtgcccctgtaaagattaaattttatgattcacatcatcaattagttgcaacacggcaatacgctacagaatagtttagattctaaaatatccgtttaaatcatttttggtttagacggatatttttttatttccgctgagctctaggacggctcagagtagcaagtgcccataaataaaagcatgcctactgcgggaattctcccgcttacggcacgctccctctttcctctttatttccgctgagctctaggacggctcagagtagcaagtgcccataaataaaagcatgcctactgcgggaattctcccgcttacggcacgctcttatttatgggcacttatcgctactcttcgcccactatttttatggcatatcatttccagccgcgtaataaatgtcataccattcttgcccggtcatttccacatcactaccaaccaacgattccttaatatgctgtggattcattgatcccaccaacacttggaacttcgccggatgacggagaatccatgccgttgcaatcgcattctttgtcaccccatactggtctgccaattcctgcatctttttattcaactctggaaacttcggattatcaataaacggtccgttaaagtttccccattgatatggtgaccacgcttgaatcacaatatcatgaatccgtgaatactctaaaaattgtccatcatgatccacaccacgatcatcctgcatatttgtatgcattccgaaatcaatcatattactatgcataattccgaattgaagttggttaaacatcaatttctgtgaaactgaacgttgtaacaattcaaattgcattgggttaaagtttgaaacaccaaaatgacgaaccttccccgccgtttgtaattcatcaaacgcttccgcaatcttgtccggttccatcaatggatctggacgatgaagtaaaactgaatccaaataatctaaattcaagctttgtaattcatgattaacagcatcaataatatgttgttttgaaaaatcataacgatttccataaggcttaccagaaccatcatcgttaccattacgaattccaaccttagattgaatccataaattatcacgacttacagatgacttgtctaaagcatccctaaaaacgagatctgatttgccaccaccataaatatcagcagtatcaataaagttcacaccgttatcaacagctgtttcaattacttttgttgcagcatccgtatccaacgcatccatacgcataattcctaacgcaacgttagaaacttttttgccaccaattgtaatttgtttcaaaagtatcactcctaaaattaaatttatactatccagctaccagcttaccacctttcaaactaaaactaaatcaatttggcatcggttacaatatctatatgtttcttcaacttgagattaaaaaagagaccatcacaacaactgtgatggtctctttcatcaaatttaattaaactttagttgattggaatttgtttgccactttgaagcttttcttcactctttggcaatgtaaccttcaaaacaccaccgtcataggaagcactaatcttatcacgatcaatatttggaagatagaattgacgagacacattgctgtaactacgttcttgacgaattaaattacctttttcgtccttttgttccttatcaacattatgtttgcccgtaaccgtcaatgtatcattatcataattcaaatcaatattttctttcttgaaaccgggcagttctgctgaaacttgataatccttttcattttcacggatgtccgtcttcattgagctaccttcagtcattgatttgaagaaattcttcccaaaattatcgaaaaaatcaagtggtgcaaaatcatcaaaatctctgtttctcaactcgttagccataattcaagactccttttttatataatttttcgtacctaatttcctcggtacaactatatagtaagaccatctaaaatcgaatgcaagaatttagcactacacatttaagagtgctaaaacaattagctagaatcccgtggttgagccattttgatttcagcattttcaatctaagcctagaataattagcgtcaaatctttgctatcatcaaaaaaacaactatctccattaattggaaaatagctgtttgaacttttagttttagtaagtaaccattttatgcgtttcgttaggtttgtcttgaactttcaaatctagcgcctcacctaaaatgtgtaatgccttctcacgagtcttgacttgatccatatcaaagataattgattcaatcgcaccaccaatgaagtcaaatcgttcacagaaaatgtaaggatcttcattatcacgatgatgaaattcgtcttcaattttttcgtagaatccttggctccataaacggtcatgcatatcaggaaaatcatttttggtaacgaagcccttctctgcaatcatgtcagctgcttgtttgacgtcttctttatcgaagtcaatctttgcaatctgttcttcatctgtttctactttaattccatcatcttttgccatttctgagatctccttatttatatttttacgacctcatcctagcactacttttttgaatcgttaagaaaaagcgctttatttttgattccacgtcgcaatcatgcgtttttgccgccgaattccccacagcttatctagctcggttacaatcaagacaacaattccggcaaacactggaatcaaccataagtgccagtctaaattagcagtactaaaaatcacctgcataaatggcaagtatgtgattccgacctgcagaatcaggagaaccgcaataatggcaaacgccatcggatttcggaaaatatcttttgacaacgcaggtttgggtgttcgaatattaaacagataaaaaatcttaccgacaacaatcacatttaacgtcactgtacttgcaaccacagtactaatatcttgcaatgtcaaccacttgaaagcactgattcccaaaccagcaattaaaaaggaaacatagacaatctgccacacatcttttcgatttaagaaggcttggttactctttcgtggcatgcgtttcataagtccctcttcggccggttcaaacaaaaaggcaaactggatcgtaatggcggataccatgttaatccacagtaactgggttggcactaacggcatttcctgctgtaaaagaatcgaaatcaaaacgatcaaaccttctgcaaaactggttggcaacaagaaccggattgtcttcttgatgttgtcataaacatgccgtccctctttaattgcggttgttagtgtcgcaaaattatcatcggctaagaccatatccgcggcctctttggccacatcggttcctttaattcccatggcaattccaatgtcagcctttttcaaagcaggcgcatcattcacaccatcacctgtcatcgctgtaacgagaccatttgcctggtaagcttccacaattcgtaacttattcataggtgtcgttcgggcaaacacattatagttttgaatcacttttttcagttgatcatctgaaagttcgtcaatttcggcacctgtaatggccgagattttagaatctaggcccagttttttggcaattgctgccgctgtttcaggatggtcacccgtaatcatttttactttaacgccagcttcgcgcatctcttttaaagccacaattgtttcttcacgaggtggatcgataatcccggcaattccaaggaactgaaccccttcaagcaccaactcatgggttaaagtgtgaacttcacgttcaacttttcgatagccaagagcgaccacccgttcaccattgcgtgccagtttggaaacttgattagtccaggcatccacgtcaaacttcggatctgcttgtttggccattgcaaacaccttatcaggcgatcctttgactaaaatcactctttgaccgtcactatcttcatccaattttgcaatgtatcgataatcagaatcgaaaggaattttatcaagctccactaaatctggttcgtttttcttaaatactttatgatacaaagttaaaaaagcaccatcagtgggctcaccattaatttcccatttaccctctgtttcgataagccgggtatcatttgcctcatgtcctgctaccaataaacgatccaaatcctcatcacgaccgggaataattgcctggccattttgcgtaattttaccgtctggttgataaccagttccgctaacttcgtagtgaccttttttcgtaattaaggtatcaatggtcatctcatttttagtcaacgttcctgttttgtcagtattaataacgtccactgctcccaaagtctccacggccggcaaagttttgacaattgcattagcttttgtcatcttcttcacacccatggcaagcacaaccgaggtacttgctggtaaaccttcaggaattgacccaaccaccattgtaatcacggcaaccattaaaacggaaagcgaatagacttgagtgatcagcccaaaaacagttaacaaaactgccacggccacaatcgcatatgacaaatacttacccaaatcattaatttcacgcatcagcggtgttgttttggattgcaccttttccatgctggcattgattttaccaatttcggtttcagcacccgtcgcagttacaaggcccagaccactaccgttcgtcacagccgttgacgcatatgccatatttaatcgatctgcgagaggtgttttcggatcggtcaataattcatcattttttaaaacagaatcagtttcccctgtcaaagaagattcttgaatttttaaattatcggcggttaaaattcgcaaatccgcgggaacgttatcgccagcctctaggaaaaccaagtcacccacgactaagttttcggcagcaatatcttctcgtttgccatcacgaataaccgttgctgaaacttgtagcatttgtttgatcttttcaatggcttcagaagccttactctcttgaaaataaccaatcagtgcatttataatcacaaccagcccaataacaatcgaatctgaatattctcttaaaaagaaagtcgcaatagctgcaactaaaagaatataggtaatactattgttgaactgtttgaaaaaccgtttcagcttgctttgcttcttttgaatcaacgcgttgggtccattttgtttgagtcgtttttcggcctctaaacttgtgagcccttgatcaagctctatttggtcttgccctaagagttgatccacagtttgcgtatacgggtggggtggtttaccctttttcaattccccaccatagtcggtactatccgaagcagaactttttgtcataatttaaaactcctcctgtaaaaatttattctggtattatctttggtaagtaatagcatatctgaatttaagtgtagtgtcaaaggataacttatccgttttataagaaatcttaaactgttcacactattttcatattcattcttaaattatcgcaaaataacttatatctgtggccaattccgaaagatttttcttatcagacgcgctataatatagagataatgtaattacaaaagaaatggggaatgttccttggacagtggtcagataatcagcgatagtattatcattttgattaccttcatcctggcatattttttcgttgccgcagaatttgcacttgttgaaagtcgattaagtgcattggaagaggcacgggaaacagcagttggtggacggctcaaaaaaattaaccgagctatccacatggtttcaaatttaaacgaatatctttctaccacacaggttggaacgtcagtctgtggaattattttaggttggataggtgaatcgtttgtagaatacttcattattcgcttttttggattcacacatctcattaatcaagcttcgctacacgcgattggagcaattattggtgttttactcctaacctacttggaagtcgttttaacagaaattgtaccaaagaatattagtatcgatgtccccatgaaagtcttaatgtcgattgtgaccccattacattggtttcacacggcattttatccattcgtttggttactaaatgtttctgcaagtggcatcgtcaaaatggtgggtatggagcctgctgatgaaagcaacgaggtcttttctcaagcggaaatcctgagtctttctaaaaatgctgtttctggcggtgaacttgatcaaaatgattacgtttatatgcaacgtgcttttgattttaacgataaagtcgcaaaagatattatgattgatcgtacacaactggtagttctggatgtgaacgctacagtagatgaagcgttattgctttacctgcaaaagcgtttcagtcgtttcccagtggttgcaaataacaacaaagataaaattctgggctatgtttacaattatgatttgattcgtcaaagtcgagtagatggcgatattaaggtcagcaagttactgcggaatatcattaccgttcctgaaactgtacctttgcaagacgttttgcaaaaaatgctccaaaaacaaacgcctatttccgttgttgttgatgaatatggtggtactagcggtattattaccgataaagatatttatgaagaagttttcggaacaattaatgatgaagttgacgatgtttctggcgattatattcataaagaagctgacggcacttatcatgtcagtggtaaaactaccatgtatgattttgaacggtactttggcattgacgttcccggtttcgagggcgaagatgtggtgacgcttggtggatatgtcatcgatcatcacccaaacattcaagtgcatgatcaagtccgtatcgatcgctatgattttgaagttcttgataatgagaatgcacatatcgattggttccacgtcactagaattcctgatgaagaatataaaaagttacaaaagcatgcagaagatgaacggttaaacgcagatgaatagcgtgtgatagacacaagtcgagttaattggcttgtgtcttttttgttttgttatgagtttgattttacgttacaattcgctcactttttaggacagctgcttgtgacagccaaaatccgctcactttttaggacagctccacaagacagttccagaaatataaacccgcctagcgcaggacttcttcctgctgccggcacgtttatatttctgggactattcgtcttcatccgctcacttttttaggacagctccacaagtcataaaagatcccataagcatgcttccagcgggagattcctcccgcatccatcatacttatgggatcttttattacgacttgttacgctcacttttcccttaggacggctcggcaaagcaagtaagggaaaatagccatgattcccgcgggattgcgatcccgcttccatcatttcttctctgctctttttcgctaagatgtaggacggctcggcaaagcaagtaagggaaaatagccatgattcccgcgggattgcgatcccgcttccatcatggctattttcccttacttaacgctttgcctcgcccactaatctaagaaccttctcttcaaatactttggcaaaccgtcatcttcacttgcttccgttacctcatccgcctgggcctttatttcatccgcactattgcccattgccacacccgttccaactgccttcaacattcccaaatcattcttatcatttccaaacgcaatcgtatgatcctccggaattccatactggttcgttatcgcccgtaccgcactcgccttatccactcgtttcggaatcaactcaatattatctggactcgatgacgacacatttaacacctgcgcatctatcaatttttgccttgcaatccccaatttatccaactcaccctttgcaatcacaattccattaataatttgatcactcacatcgttcaaatgatcacggtcatgcacatcttcaaattttccagcaccatcttgcataactcgcatccgcgccaatcgactcaaatcccatggcttacgtctcgtataaaaagttcgatccgtactaaaaaaattggtcgacaatccaagctcagttgtcacatcataaaccgtactaatcgctttccaacccaaatgatccatatgcaaatgatttcctttttgataaacagatccattcgacgcaattacttctaccttcgaattaattcgtttttgaattacctgtgctaatgaaagcatccgtcccgttgcaatgtaaaagataaatccttgttgctgcaactgttcaatcaccttttttgtcattgccgatacattttgattatgtgaaattagtgtgccatcaatatccataaatactatataaggttccaaagcgttagcctcaattctttttcaattttgtctctacagtcctagtttactactttactaaagcggttccaccgtttttaaaaaatatctttttataaaaaattaagtgttacaatgttaataatgttctacaataaaaatagtaaagtttaagggggttccatcatgtcgattattaacattttatacatctcagtcgctggaaatacacgctccttcacacaagatctccaagactatgctgaggagcaacattcaaaagatgccgctaatcccctcatttcattaaaagaagtctctgaagaaactgattttgagagtgaacaagaaccatattttgcgtttgtacctacttacctagatggcggaaacggcgttgacaatggtgtcaaagaactcatgaccaacgttttgggcgaatacattgcctacaaagataaccgcaaattatgtcttggggttattggcagtggtaatcgtaacttcggcctgcagtactgtttaaccgccaaacgttatgcccgtgattatggttttgaatatttggacaactatgagttacgcggtaataccgccgactgcaaacgaatttacgaaacaatgaaaaaaaacaatgttttaaacaccgtctcaaaagaagtttaattagttttaaaagtcaaaaccgccaaattcaaaaaatgaatttggcggttttggtttctgtttttaattttaacagctataagagtagatatttttctaggctaatgcgcttctatttttatagccgaaacgtgctaaaaagagcagccttctccgctcagctacgatagcccaacgattcctaaaccgaatcattgggctatctatgctatgctcgaaagctaaacgctctttttagcactcttttatttttaccaagtaatcgtatccggatccgtcgccaatcctgcaacgccacgcaacccatcaattgtcttcatatctgcttcatcaatctcaaagtcaaacaactttgtattttcaataatacgtgcttcatgcactgactttggtaatggtaaaaatccatgttgcaatgaccaacgcaacactacctgtgcaactgtcttgctatacttctcactcattgtcttgagttcatccacagcaaaaattttacctgtaccaagaggactatacgcttctgacaaaatatcatgcgcatcattatacgcaacaacttctggctgcaaatcactcggattcaagaaaatctggttaacttgcggtgtaaccgtcgccgtcttcaacaatgcatctaaatgcttaggacggaagttagaaactccaattgtccgcaacttgccagctttttgagcttcttccattgcgcgccaagtatccgcattcgtcttttcccatgaatcacgataagcaattggatttggccagtgaattaagaacagatccaaataatctaatcctaaattattcaaagatttatcaattgccttcttggtattttcatatccatgatcgtttccagtcaactttgaagtaacccaaagttgatcacgggcaacgccactatccttaatacctttacccacacttttttcgttaccataagcaaaggcagtatcaatatggcgataacctgctgcaatggcctcttcaactgatttctcagccacatcaccatccggcgtctgccaagtaccaaagccaacaattggaatcttgacgccgttatttaattcataggtatctgttaattttgttaattttgccaaaataaatcctcctatcaaatattatctacattataaagcaaaactactagacttgaaaaagatttggtttccgcgctaaattattctatgagaaacgcatataaacgctaatttaaggaagtctcgttgtgaataaaaaatctgatttcaataaacgcctatttttcttagccatttccattgtcctaaactcattttccaacgcgttaaccgtggcgagccactgtggaagtgccttatggacggcttcttctgtcaatttgagcgaatggtttaattttccactaggaactgttttatttgtcgaaggaatcgccgtcgttatcgcaaatggtcttctactcaaacattttgactggcatcgcatgctgggaaacttagtatttatggtgccattttcttatttagttggagcaattagtagtggtttagatacgcatggttttttgaacttaccattaagtgtccgtattatcgctgatgccctcggaatcgtggggattggcgtagcggtttccatttatcaacgggccaacatcgtgttacatcccaacgatgacttaacttacatcgttcgcttcaagttcatgaacggcaaagcagcggttgcccagtgggtcagctatattccagccatttcaatcattttattgacctttatcgtcacccaccatatttactcgattggtttaggtaccattcttgctttcatcctgcaaggagccgtaacaggttgggccgatcgccacgtatttacaactcttaaacatcacttaaatgtttagacataattggtaggaagaaaaacgggactgtgctatcattttatatgtaggatatttcataaaaaaaacgatatgtgggaggatttatcatggtgagatcacgggtactgcagttacaaaaaggcggcaattttcgagaacttggtggttatcagacaatggatggccgcacaattaagtggcataaagcaattcgttctggaaaactcggcagtttaaccgatcaagacgtctcttttttggacacttacggattaaaatatgacgtggacttccgttcgcctgaagaaaaggcccaagcaccagaccgaatcccagcccaaactaaatatttatttatgccagtattttcaactgatgaaacccaaaactccaagcaaacggatcgcttacaacgcaaaatggacactgatcccacaactggtcgtcagcaaatgcatcacgtctatcaagatatcatcacgaatccccactcacaaacagcttatcgacgtttctttgacgttttgttggaaaatgatggtcaacaagataccttacttttccactgtaccgccggaaaagaccgcactggcatgggcgccgttttctttttaagcgcccttggtgtaaatgaagacaccatcaaggctgattatttactcacaaacaaaaccacaaaaccaatgttagacaatttggttaaaaccttgaaactcaagaattcaccatcagccttcattcaaagtatgcgtgatttacagagtgtacaaatttccttctataataccgcgatggatcagattcaaaaggtttcaggagacatgccaacttacctccacgactatttaaatctttctacgaacgatattcatgatttacggcacatttacttagaataatattttctacaaacaaagagggctattgaatgaaaagaaagaatcttattggacttggaattgtggcaccagtggccttaggagtttctgccctaacggctgccagtgctaaattatacgattacgcgtttcggcgcgtggattacgttcctgaaacttcagcagataaacagaaatatgcagatgattattacagatatgtaaactggtttcataaggtaaccacgaaacagtggacgcttcacccttctgatttagaaaaccgtgtcgaagcgacttttattccatctgcaagtgaaaatgccaaaacgacagttatcatcgctcacggttataaaggtaatggcgagacgatgtcaaactacgctaaaatgttctatgacatgggttacaacgtcttgttaccagatgatcgggcccacggcaatagctcaggtgactacattaactttggctggattgatcgcctcgactttgtggagtgggcacattctgtcattaataatgtgggcgaagattccaagattattatgtttggcgttagcatgggtggtgcaaccattcaaatgacgagtggcgagaatctccctcctcaagttaaactaatgatttccgattgtggctattcaaatttacgttctgagttggcttatttgctgaaacaccaatttcatttgtcaccaaccgtttttgtgccgatcataaatgcaattaatcaccatcgaatgggcttttcgattgatgatgtttcctcggtcaaacaacttcgtaaaaatacccgcccgtttttatttattcacggggaaaaagacatttatgtccctacttacatggttgacgaatgtttcgaagcttgtcctgaaccaaaagatatctggattgtgccaaatgcatcccacgctgaaagtttctggatgaatccaaaagcttatcaagctaagattcaacggtttattgataactattcagattaacctgtgaaataaaataaacatgacactaggaacgattcccaagtgtcatgtttttatttaagcaaatttaaaatgtttacctttttaattaatagtcttcagtaatttctttcttttatatttcgacgatggacgatgctagaaacttaccatacattttttgcctttaagcgtcatgtaaaacttccagcatttgagcgaaagtcacgcgtctagtttctcttgggataaagcttcgaatttcatcttcgttaaaaccaacttgtaacttattatgggtgaaaataattggttttttgatcaaacttggatagttcactaacaaccggtgcaattcagtaattgtgagtgaatcgatatatttacggccaaattttttaaacatcttagatctctccgaaatgatttcatcggcgccgtattctgtcagtgataaaactttttttaaagtatctaacgaaattgcctgtgaaacaacattaactttattgtaggctaaattatgttcatctaaccattgacatgctctccgtgctgaaccacaacttggaccccataaaactgttattttttccatgcaaagcgctcctttaaaatttagttataattaccataagtaaaattatagactaaacaattagttttgtctactcttttttttaactaattgtataagctcaaccaagattaatctattgagcatttttctttagggtatgttaaactttagatatcaactaaaccaggacataggaggattttcatatatggaaacaaaaagatcatttaattggaaagcgttgttacttttcattgtcggcgtcgaagtacttggaagcctatcttctttgtttgccggaaatatcaaagaaatttataattcactgtccctcccaccactagcaccaccagattatctttttggaatcgtttggccactcctttatttgttaattgcaatatctggctaccttatttaccaatcaattgcttttaaaggtgaaaaaacaacaagttacctattgtttgccgttcaattaggcctaaactttgtttggagtattgttttcttcggtggaaactactattgggttggcgttgtgattgtgattattttggatttggtcgtgctaggttgcattttacaatattataaagttaaccgggctgcctcagtcttactaattccctatctaatttggatcttgtttgcaacttacttaacgattggtgttgcagttctcaattaaaatgccgtcaaaacgtggctgattgcgagttaacaaacctttaaatctttcgtcacacaatattcataaatagagggtattataataaacatagataagagctaaacaactttatctatatgaaaatagcatactcctccaaagttactatatttcattgtttttcatgataacaacctactcccctatataaagagaccggtcagtgatgatcgggtctttttttgtttacaatttgatttttaaacgaaccaattcatatttggtataatgaagccaatgatagtttggagggatcaaagtgaaaaaagaacgcttattagatatcgacggtagtgtcaactttcgtgaactcggcggatacaccacgcaagatggccgcacaattaagtggcaaaagctattgcgatctggagatctcagccgtttaactgctaaagatgtgaaaaagttggctaattatgggttgcactacgacattgatttacgatcaccttctgaagctagctggttaaaggaccgtttaccagataacaccatctatcgttcttatccagtctatccaattgcccaaaatgaccactctgaccttccaaaggtaccggaaaattcagacaatgctgattattcgcatccctacgcactcatgattttaaatccacaaagtcagttagctttcaaaacaatgtttcaagatatgctgaaaaatgatcagccgaagcaatcacttctttttcactgtgctgctggcaaagatcgaactggtgttgctggatttttaattctaactgctctcggagtagattacgacaccatcaaacaggattacattttgacaaacattgtttacagcacctttgatcaagacactttgcgtaagcgtctgcaaaatgacaaagcagaagagtttgtcaatcaaatgaatgccgcatttcaggtccaaggtgacacacttgatgtggccaagcaggcaattcttgataattacggtgactatggtaactattttgttaaagcgatgggattgtctgaagctgatttaaatgatttaagaagaatttatttaacttaaagaaggcacattatgaaaaagcagcgcgttttacctattgaatcgggtttaaactttcgcgaacttgggggatatcccacgcgcaatgggaaaacaatcaagtggcaaaaactgctacgatccggttatctttctgtgctcaaaaaagaggatcgcaactttcttttgaattatgggctgcggtatgtggtcgatttgcgatccgattatgaaattacccgtaatccggacccacaaatgatcaatgtcagacaaatttcagattcggtatacccgtttagcaaccacccttctactagcttgaaacaatttttcaaaaatctctttcaaaaaaacaaaactgaaaaaccaagtgcactcagtgatccctatgaattaatggttttagacaatcacgcacagagcgcttttcgccaattattccaaatccttttgaaaaatgatcagccaaatgagtccgttttgtttcactgtgcagcgggaaaagatcgaacaggaattgccggctttttgattttaagtgctttgggtgttgaccaagatacgattgaagaagattatttactttcaaataaggtcctttttggtaccagaacagttaaaactgaaacaaccaataatgccgctattgatcgaatgaatcaggcacgcaacgttgacttacacagtttacggttagccaaaatggcaattgaaacaaggtatggcagcatgcataagtacttaaacaccgcaatgatgctttccgatgaagatattgctgaactgcaacgtttatatacagaataaaaaatggacccggaaaagcttgtattttccgagtccattttggatttttaaacaaatactagtaacacaactgccaataagaatgccactccgagaaacgctgcagaaacagcttcccaacgatttgcacctttcacgtctactcgaagaccaaataaaacactaaaggctaaaataagaatcaacattttttcgatttctgaataatcattacttctttgaaagtatcccgtaaaccatcccacaatgcaggcaatcacgacaacaactgcgatgccaaaatccgtccagtactttgtgcgcatgtgatcacatcctatgttttaatattgcttctatactaccttacttgttggttgaatagcaattatcagcatattgccaatttaaacagaatgccactttctttcattttgtttgcactcaaaacctatcgattcgttgcgttcacttttcttcattcacgtgctacactacagtcaacaaatactaatagataaggactgattaacatggctacaactgccgaaaaaatttggaccgccttttccgaatcccatcaccttaccaacactacctttcaaactcgctggtttggtgaacaatccaatccaaccgaagttcaagacttaactgacaaaattcttgctggggacaaaatttccacttctaaacctttaggctactattcatctgagggtgaacatattcctcaagttggtgactactatgtccttttaaacgccgacatgcatcctgttggtatcattgaaaccgtcgtctccgaactggttcccttcttccgcgtttctgccgaacatgcatacaacgaggctgagggtgaccggaccctcgcggattggcaagaacgcagcaaagaaaagtttgctaagcaaatgaaaaaatatgatcgtactttttctacaaatgatcccgtcgtttgtgaagaaatcaaactcgtctttaaggcttagttatagaattcatatgaatttacttatcaaaaagatgtatgtataatacacattatagaaatccactctgaagaaaagataggagaatgtgtatgaaaatttatccagctgtttactctgttcaaaatggaatcgttgagttacttattccagattttccgggcatgttaattgaaggtgaaaaccttgttaaggcaaccgaaaaagctgaaaagcaaattactgcccaaggaaatttgcctgaaccttccgttatgaacaataatcatttagtggaaggcgaacacattatcatgttaccaattaacgaatacgcgggcaaaagcaccaaacggattcgtcgaaatgtgacgatccctcagtacttaaacgattgggccaaacaaacgggtataaacgtttctcaaattctcacagaagctttggacaaaaaatttaaaacaaccgaataaatacctcaatccaagaatttcttgcaaaagaagttcttggattctttgtgtccattaattttctaattaagtgtagtagcaaaaaataaaattgtaacgagttttcaaacaacaactgcaacggctccaaaagatagttgcaactcatcctcttgagaaatggatacaatgtttcaatacactcgcaactagtcgtccgctttgataacatcagaacgacaatcaaaaaaatattgagtttccactagttagaaacccgcttcaactgaaactgatgacagttttcacttcttttttgaataattttggggatggtcgtggtaaactaatttccaaaggggacgtttttcatgacaactacagactcaagacactggaaattaaacgtcggttattttctagcggcacaaaatttttttctgtttggttcatcagcagtttactttgccattctttggtacattgccctccaaacttcatccggaacttggatcatgcttgccaccatggccactacgctaccacaaattctaatttcactgtgggcaggcatctggtcagatcaatatagtcgtaaaaaattgattgtggcatctagcggactagtcacattcttaactattattacggcgttaatttacttttttgtttttcgaaatttatggttgttgttactaattgccgccattcgttcgctgggatccgggattcaaacaccagcgggaaatgcccttctaccagaaatcacaccaaaaaaagagctttcgcggattaacggcttgaatcagtttgttagctcggtgttattgctaatctctccaattctaagcggtgttatcctaggaaaactcggaattatttttgttttcgtggtggaccttgtgaccgccactactggaatcgccttattgttatgcattcatgtgaagcagcttaaacaagaaaagcaaaatcaagttgctgggttaccaggtatctgggaagggttaaaatacacgttctctcatcaatacttacgaaattttatggtgtttaccttgatcgcgttcgtactggtcgcgccatcatcccagctatcgacactttatgtgaaacgaacttttggctctgcagtttggcgattgacgttaaatgagctgctatggaccatgggggccttgcttggtagcttttacatcaccattcacaaacatttaccccataaaattcggttgattgcgattggttttgcaggatctggcattagttttgctgttatgggactgcctgaaccattttggacctacctacttttcatgtttttctcaggaatctgcatgccagttattcaggcaacttccaacattttgattcaagaaaatgtttcgcccaccaaaatgggacgggttttctcaattctccaaattgtgtcaaccggaatctacccaattgccatgctgttttatgggcctttagccgatgtggtggcgatccgttacattttgattgtcaccggaattttattaattttggttgcgggactcttttataaacggctccctcaattaactgacaagctcaaagatttgcattaatctagcccaacacgattaaaaatataatccacattttttagatgatacctgtaatcaaaggcatcatctatttcttttggcgaaagatgactcttaatcaccggatcagattcaaccaacggcttaaactgaatttcttcgtcccatgctttagcagttaatggttgaatgcgatcataagcagcctctcgtgataacccagcatcaattaactttaacagcacccgttgactataaattaatccaaaactccgatgcatgttggctttcatatgttctggaaatacagtgaggttaccaataatgctgttcatccgatgtaaaatgtaatcaaccaagatggttgtatcaggcaaaataattcgttctgcagaagaatgcgaaatgtcgcgttcatgccataaattgacgtcttcgtacgcagtttgaacgtgacctctaattacccgagccaagccggaaacgttctcagaaccgattggattacgtttgtgaggcattgcagaagaccctttctgtcctggcgcaaaatgttcttccacttcacggacttctgatttttgtaacccgcgaatttcagtggcaaactcttctacacttgtggcaattaacgcaagtgtcgcaatatattcggcatgtaaatcacggggtaaaatttgagtcgaaatttcttgtgcattcaaacctaactcctcacaaacaaatccttcaacttccggtggcacattagcaaaagtccccacagcaccactaattttacctgcttcaaccccttttgcagcatgctcaaatcgttcaatatctcgtttgatttctgaataccagcgcgccaattttaatccaaaggtcatgggttctgcatgcacgccatgggttcttcccatcataacggtatatttgtattttttggcttgtgatgccaaggtatctttaaaagtttcaaggtctttacgaataatcacattggcttcttttaaacgatatccctgagcggtatccaccacatcggtactcgttaaaccataatgtacccactttttctcttcacctaaagattccgaaacatcgcgggtaaaggcaattacatcatgatgggtcacagtttcaatttcggcaattcgttcttcactaaattgggcattctttgttattttttcaacatcggtcgccgagatcttccctaattttccccaggctttgacggccgcaatttcaactttcaaccaagatgcatattggttgtgtaaactccatacattacccatttcttcacgtgtatatctctctaacattcgtatccctcacattttcgagtttaaaataagtgctttaaatatccgtgtaatactatagcatacatatatcggatattccacatacattaaactgattgaggtttctcacctgctatttatcagtgataaaccgtactttaaaatatacatcatacatataattcgtgttttgcttgcttttcgtcaaaaaccttgttacacttatttggttgtttaaattatattattcgggggtcattaaatgtcatcaatcgtagttgtaggtagccaatggggcgatgaaggaaaaggtaaaataacagatttcttagggagtgacgcggctttaaccgttcgtttctctggtggtgataatgccggacattccatcgtctttaaaggcaaaaaattcgcattacaacttattccatccggaatcttcaaccgtaatggtttgagtgtgattggcaatggcgtcgttgttaatcctgaatctttacacaacgaattgcattatttagaaagtaacggtatcacaactgataatttacggatttcagatcgtgctcaagttattttgccttaccacattcgtttagatgaattacaagaacagtctaaagcagctggcaaaatcggtactacccacaagggaatcggcccagcatatatggataaagcggaacgaatcggaatccgaatttgtgacttgctggaacgcgatacttttgaagaaaaactcagaactaaccttaaaaataaaaacttattatttaccagattatatgaaacagaacctttaaaatttgaagatatttttgaatctttctaccaatacggtcaagaaatcaaagatcgtgtcaccgatacttcggttttaattaatgaggcccttgataagaacgaacatgtgctattcgagggctctcagggagttatgttggattacgatcacgggacttatccttatgtcacctcctcaaatcccactgccggtggtgctgctgtgggggccggtgttggtccatggcgcattaaccaagttgtcggggcatgtaaggccaacacatcccgcgtgggtgatggtcctttcccaactgaacaattaaacgaaaccggtgatttcattcgcgaagccggtcatgaatacggcacagttactggtcgtccccggcgcattggctggttagacactgtcgttttacgccacgcaacgcgagtaagtggcctaaccagtttatgcttaaactgcttggatgttttaactaacttaaaaacgattaaaatttgtacagcctatcagttggatggtcaaacaatttatcactatcccgcttctgaaaagcaaatcgaaaaatgtgaaccagtttacgaagaacttcctggctggacagaagatattactaactgtaaaacactggctgaactacctgaaaatgcgcgtaattacctgaaccgcgtttcagaattagttggtattcccctttctacattttcagtaggacccgatcgcgaacaaaccaacgttttgactgatatttggaatgcaaaataacgtttagaattttaactttgaataggagcgataaccatgagagtttttgattatgaagacgttcaacttattcctaacaaatgtattattgacagccgttctgaagcggacaccactgtaaaactaggaaaatactcctttaaaattccagtggttcccgcaaatatggccacggtcatcaacgaagagttatccgtttggctggcaaaaaatggctacttttatgtcatgcaccgtttcgaaccggaaacacggttggcttttatcaataaaatgcatgagcaaaaattaatcgcgtctattagtgtgggtgtgaaacaagaggaatttgatttcatttctcaactggctgatcaaaatatcacaccagaatttattacaattgatattgcccacgggcatgccaatagtgtgattcgcatgattcaacatattaagcacctgcttcctgaggcgttcgtaattgcgggaaatgtcggaacgccagaagccgtccgtgaacttgaaaacgctggtgccgatgcaaccaaagttggaattggtcctggaaaagcttgtattactaagctcaaaaccggtttcggaactggtggttggcaattggctgcaattcgttggtgtgccaaagctgccagcaaacccatcattgctgatggtggcattcggacaaatggtgacattgccaagtcgattcgatttggcgctaccatggtcatgattggctccttgatggcaggccaccaagaatctcctggcaacatgattaccatcgatggcaaaaactataaacagtattatggttcagcttctgaaacgcaaaaaggccaacacaaaaacgttgaaggtcgtcaaatgttggttccttatcggggtcacattaaagatacccttgaagaaattcatcaagatttacagtcctcaatttcttacgctggtggccgctcattggatgccatccgcaaagtagattatgtcattttacacggagtaaatgattttaactaaaaaaatggggataaaaaacaatagtttgcaacccatatttcaaattaaaagggcaatttcaccgagtactatcagtgaaattgcccttttctatcactattttaaattaatcacttcgttgccaaactcttttagtagcttgagtagcatatcaacctttttttggccaaacttaatgatccagccctcaaaaactaaatgcactttttgatcaatcagtttttccacttctgcaccacgctgggtcaggtgaagatacaaccttctttgatcctttgggtccggtgtttgagaaatatagtttaatttcaataaagatttaatttgtctagaaactgcgctccgagtaacatttcgttcggtcgcaattcccatctgcgtcacattttcctggtagcgaatatcccgtaaaaccaaaaattgttcaaacgagatctcatattcctttgtcggttccgaaaggacatactctaaaaatttcaatgtagtcatgtaaatttcaattgaaccttcaaataaagcttcattctcttttgctgacacagttccccaacctcctccaaaattgttaactgtttaagtatagcaaacaaaacttcaaaaggttatggatttagcgatctttcactaatccataacttttttcttatttccaatattttttaaaacgtttactccaattcttggtcgtatcttccatatttccaaagcgcaattcttggcttgtcgcgttaataacgccgccaatcataatcactaagccggaaaaatctagccaaaacatcaacgcaataaacgttcctaaagtcttataactgtttacagaatgagcaaaataacgcaaataggcagtaaaaaattgagaaacacccatcaatccaatggttgccgctgcggctccccagatcacatatctaaacttaatgcgggcgtttggaacaacataatacaaaatcatcaaacttaaaaaaataacgatcaaagctgatggcagtttcacgttacccacaatatgaaaaaggctatgcggtaactgcagaataggcgtcaaatacgcaacaattgtttgtccaaaactaaagaaaaacatcatcaaactaattaaaaccgcaaagaaaatagtaaacaagaatgaaacgacgcgatttataatcggattttgaaattttgccactccatacgctcgattaatcgacctttgaaacgcggcaaccgcctgactagcagaccacaacatcaaaatggcaccaaaggacatcaactcgccgtttcctttttccaaaaagtctttgacaatgggctgactaatctgataaatcatacttgggacaaccgtttcaatgtattccagcactgttgtcacgtcaatatgaaacagtggcaacaagtttcctacaaagataattgccggaaacatagcaagcaacgtatagaaggcaaggacaattgcattatttgcggcatctgcacgattaaatcgcatcataaagccttgccaatatgttttacatttatgcccaaacctcttccaaatcatgttatataccccgtttttatttaactttaatagtatacaacaatttactaagttaaccctttttttctgaatttttaatcaaaattgaaagcaataatcccaaaatctctacaagaaagaaagtaaagaacactgcccgatatcccatttgagtagcaacttccacgtgactgcctttggtcaactcactttgcgtaatcgccgttaatataatggtggcaaccgctactcccaacgaaccaagtatttgacgaacagttgtaataacggccgttccatgagcaatgagactgtctggcaaagagtttgcccccagtgtcatcgcgggcatcatgacaaacgcattgccgccttcgatcaacattgacaaaatcaccatgccaatcaaatttagctcactagagaatacaaacaaaattccccaacctattgtaatcatgctcattcctattaacagcacgcgtttgaacccgaatcgatcagccaacttgccagtaacaggatttagtaaacttaaaaatacggcccctggtacaagcgacattccggatgcaaaaggcgataacttaagcacctcttgataataaagcggaaaaataattgtcgtcacaattaaggcaatgtaagaaaagcccgtcagtaacacggctaaatcataattaaacgttttaagtacacgcaattcgagcattggcgttttgatgtgaaattgacgaaacacaaaataggctaacatcactaaactaacggcaagtaaaccaaactggttcgtccagttaacaccagttttacctagttgattgataacaaaaagcagtccgatcaaccctaacgaactaaaaaccgagataaaatctaaccgatctagtttcagtgacatgacatttgcaatgaatttaaatgacaagagaaaaactagcgtaataataatggcaaaaatcacaaaaagtccttgccaggtcgtaaatttcaaaacaattccagaaatgattggtcctacagctaatgctgatcccatcaccagccccacaatgcccattgtgaccccgcgtgattcttctggtgtaattgtcaacatgacactctggtaagccggaaataagatcccaacgccaatcgcttctaggactcgtccaaacatcatgatcggaaaattaggtgcaaataaaataacaatcgttccaacgtcaaacaacactaacacggcttgaaatagccgtttaaacggtacattacttaatagccagggactgataggcatcatgatacacataaccaacatgaagcctgtcgtcagccactggatggttggcgcggtaacaccaaaatagcgcattaaagttgggtaagccgttgataatgaagattgactgatcgacattgtaaaagtgcccgccaataagatccccacaaaccaactgcgaagttttttatcccctttaaaaattccaagccgttcttccatcaaactcactcctcactaacttatgcctaagttagaatcattttaaatcgatttaattgtatttcatatttagactggtgtaaactgaatttgaaaattctaaacgattttattgcctgcatagagttgaagtcatcttaaaaaagtgattaagttgattgtacttattaattgtgactaacgaaatggaagaaggtttaggtatggcaaacgcagaagtggatgaagctattacagatttacaaagtaaacgcattcgaattacccctcagcgacgcacgattttggcttatttagtcacccatcataatcatccaactgttgaaaccattcacgaggccttggcacaaaccacgccaaatatgagtttggcaacgatctacaacacattaaaattatttgtcgacttaggaattgtcattgaactggcaaacggcgaagatggcgtgcattacgactatttcaataagccgcattaccacgtaatttgcacaaactgtggtaaaatcactgatgttttttatcctgactttcaaaaagatgcgagaaagatggaaaaacaagcgactcaacaaacaggctatcaaatttcgggtaatcgcttcgaaatttatggattgtgtcctgaatgccaagctaaattaaaaaaataagaattcaaataaccatccaaactcactctactaagtttggatggtttattgtttggatagcttctttccgctgagctctaggaccgctcggcaaaataaaaggcaaatcctaagtacgactcccgcgggattgcgatcccgcatatgtcgcacttaggatttgccttttaccattttgcctcgcgcacttttactcttaccttacctgtgccgccgtcattatcgccactttatacacgtcttcttcacttgctcctcgtgacaaatccgacaccggcgcattcaatccctgcaaaattggccctattgcctcaaaatgtcccaatctctgcgcaatcttatacccaatatttcctgattgcaattctgggaacacaaacaccgttgcatgccccgctacctttgaatctggtgccttacttgcacccacatccggcacaaacgccgcatcaaactgcagctcaccatcaatctccatctccggttccttctcttgtgccaatttagttgcttcctgcacctttgtgaccatatcgccctttgccgaacccttcgttgaaaaactcaacatagctaccttaggctcaatatcaaaaatttcagccgtatgcgcactttccaccgcaatttctgccagtgttgccgcatctggatcaatattaatcgccgtatccgcaaaaatataacgttcattattgcgctgcatcacaaacgcaccactaattcgttttacaccaggttttgttttaataatttgtaatgccggacgaactgtatctcccgttgggtgcacagctccagaaaccattgcatctgctttgtgcagatacaccaacattgtgccaaaataattcacgtcagttaacatcttcagcacttcttcaatagtgttctttcccttacgccgctctactaaagcatccaccatttcttgcttttcttcttccgaataattgtccggattaataatttcaacattttttaaatcaacatcatcttttgaagccttttctacaattttctttgcatcgcccaacagaattggtttgaccaacccatcttgtgccaaccgcgcagccgcagagtaaattctgacatcgtccccctctggaaatacaaccgttctattttgacccttaatctttgcctttaaaccgtcaaataaatccatgtttgaaactccttccataaaagacagaattttatatttaattataggttatgccttagtttcttttttaaatcgttcaacttcacgggcgatcgccaattcttcgttcgtaggcacaactaacacctttgccttagaatccgaagcactaatatctcgcaactcaccttgaacctggtttttttcgttatcaattttaagtccaaaataatccaactcatcaacaatcatttttcggactaacatcccattctcaccaatgcctgctgtgaaaactaaaacatcaattccgtgcatttcagcaatgtaagccccaatatacttcacaatgttattcacaaaaatttcaacggccaactcagcccgacggctcttatgtctagcctccaaaacgtcgcgcatgtcagaagagattccagaaatacctaacaatccagacttggtgtttaatatttcaatcatttcagaaaagtcagtaatctttagtttttccatcaaataattgactaaagaaacatcgatgtctcctgaacgggttgccattgtaatcccagaaaccggggtaaagcccattgatgtatcatatgactggccattcaaaatagcgtcaattgaggaaccggcccctaaatgaagggtgatcatcttcaaagaacttaatggtttgccaagtagtttggccgcatccaaagcaactaattgatggctcgtaccatgggcaccatacttacgcgcgccatatttttcataatattcataaggaatactgtacaaataattttttgcgggtaatgtttcatgaaaagaagtgtcaaacaccgcaacacttgtgacgtttggcaggaccttttgcactgcccgaattccaatcacattggccggattgtgcaatggggcatactccgataaactctcaatttgcttaattactttttctgtaatctcgacggagccattgaaaatttcgccacccgctacaacgcgatgaccaacgcctgtaatttcatcaaaacttcgaataattttcaggtcaatcaaagcctttagaaccatatggatcgcaacttcatgatctttaactggctcttcaaaccgcgtgttttcctgatcgccataaatcattgtaaatgtggagccatcaataccaattcgatccacctggccacttgcgagaactttctcgcttggcatcttaaacagtttgaacttaagtgatgaacttcctgcattaattgcaattgttttttccaaagtaaacccccactcacttttctatgggtccgattcgatcttcttttaatactttcactctaccgcgtttgccctaaattctcaacgctcatttacataaattataccttattgtttttaacatgaaaaccatatgcctatttgttattagaaactaaatatttaaaaaaagagatttattctatatagcgttaacttgtataggataaatctctttgtgccaattaatttggtagtttatttgtttgttaatttgcttgcagctgcttcatcaagaataacagtcacgttgtcatggtcttgaagcacgcttgcaggtaagtctggagtgttagggccttcgatcattcccttaacagcatcagccttttcttcaccgtaagcttccaataagatatgttttgatttcataattgaagctaatcccattgataaagcttccttaggcacgtcttcttcatgtgcgaagaaacgggcattagcatcgatcgttgattgagttaatgagacacgatgagtgccaatttcacgtgaagttcctggttcgttgaaaccaatatgaccattgcggccaagacccaagatttgtaaatcaattgggttgtcctcaattactttatcataacgctttgcttcagcatcgatatctttagccaaaccatttggtaggtaagatttcttaaatggctttttgttgaataaatgttcatgcataaagtagttgtaactttggtcattgtcagcagctaacccgatgtattcatccaaattgatagaaatggaatcgctgaaatcaagatcactagcgataatgtcattgtaagttgtaattggtgtacttccggtagctaaaccaaaagtatgagcaccatttttcttagcatcagcaaaaatcttgtagccttcttgtccgccttcaacttcatctttaacaataataatttgcataatcaagctcctttttattttctttttcgactccgatgagatctataagaataaaaatcccattcatattggtatagcccaattatatattctccctctataaattgcaagggtatagaccaaaaaatcaaaaattatttctataaatcacgatatctagaaatattccctactgaaattagacaccaccctgagaattaaattagttgccgaattttatatttatcgatatactgaattcgtaacaaatacaggggtgctggatccaatccggctgagataaaaactagtggtttttgaccctcgaacctgatatggataatgccagcgcaggaagtttaatcgttttgatgatcaagtgacagctcacattccgtcatttgatgaccaattttaaacatgcaatcaaaagctggcgcgttgtcgttggcttttttattttgtttcaagaaaggaaactatcttatgaatacaagtgttgcaattcaagttttaccaatgttagaggacgacaaaaaagttgtggctgttgtggacaaagcaattgagtacattcaatccacaggcgtttcatatgaagtcggtgcgtttgaaaccacactcgaaggcgactacgaccaactcatggaaattgttaaaaacattaccaaaattgccgctgaggctggtgcccctcaagtcatgacttatgtaaaaattgattataaatccgagggcaaggtcttaggaatccatgaaaaaacagacaaatatcaacattaattttctaccaattttggtcattctggcacttttacttatctggcaattaattagttattttcaaattgtcccgactttcatgctgccctcaccggttaatgtcgtcaaagcctttatcaccgattttccgttgcttatgaaaaattccggcgttaccctcttggaagcgttctggggactattaattggcgtcattggtggtgtgcttatcgccataattatggacttgtttaatccactctataaagctgtttatcccctgctagtcctcagtcaaactgttccggcggtggctatcgcgccccttttgattttatggtttggctatggcatgctgccaaaaattgttttaatcacaatcacgacatttttcccggtggccgtggaaatgctgaccggctttcgcgctaccgatcctgatttaattcatttaatgaaaacgatgggtgcaagcaaatggaaattatattactatgttaagtttccaaattcgttgaatcatttcttctcgagtttaaaaatctctgtatcttatgcaattgtgagtgccgtaatttctgaatgggttggtggttttagtggcttgggtgtctatatgacgcgggtcatgaaggcctatgcctacgacaaaatgtttgccgtcatctttttaatttcggctttaagtttgcttttaatttggttggtcactctgattcaacataaagtcatgccctgggaggcagtaaaaaaatgaaacattccaaacatttttggctctacttaagcttgagttttttattgatgttggttttaggtggctgcaaaactagttctaataagtcgcaaatgaagacgattaccgtggttttggattggacaccgaacaccaatcataccggaatgtatgttgccaaacaaaaaggctactacaaaaaatatcatctcaatgtgaagtttgtacaaccacccaaagatggcgccgaacagcttgttgcgagtggcaaagctcaaattggtatttctgcacaagatacgtttgctggggcgattgcccgtcgtgacccattgcctatcaccacaatcggggccattattcagcacaacacttcggggatcatgtcgcgcaaagcagatgggattacttcaccgaaaaaaatgatgggtaaacgttatgcaacttgggacttgccaattgagcaagcaactatcaaacaagtagtcgaagatgatggcggccaatatagcaaaattaaaaaaattcctaataacattaccgatgaggtggcggccttaaagacaaaacaagctgacttgatctgggtgttttatggttgggctggcgaaaatgctaaaattaaaaaccttcccatcaattatttttcatttcgttctttgaacaaggtttttgattattacacgccgaccctcattggcaacaaccaatttttaaaggcccatcctaaactggctaaagatttcatgaaagcaactgctaagggatatacctatgcggctaaccatccccatcaatcggccaccattttaatggatcaggtgcctgagcttaaaagcaaccaaaagttaatttatgcgagtcaaacctacctttccaaacagtacaccttaggttcaaagcaatggggaaaaatttcatcaactcgctggaatcgattctatcagtggctaaatcaacataaacttgtttccgtcaaactcaagaaaaatcagggattcacaaatcaatatctttctaaatgaggtcttaactatggcgttattacaaacgcatcatatttctaaaacatattcggatcaccagatacttgccgatattaatattcagctaaatcaaggtgaattagttagtattcttggtgtcagcggtatcgggaaaaccactcttttcaacattattgctggtctgctttccccagaaaatggtgaggttctgcttaaaaatcaacccattacaaataaaacgggtcaactcagttacatgctgcaaaaagaccttctgctaccctaccgaacaattatgggcaacgttattctaccggctttgatgcggggcacctcaaaaaaagtagccgaagcgaaggccgctccgttgtttaaactctttggattgcaacataccgaaaaacggtaccctcaggctttatctggcgggatgcgccaacgagctgccctattgcgaacttacatgttcaataaagaagtcgctttattggatgaacctttcagtgctctagatgaaatcacaaaacatcaggtacacgcttggtatctcaacttaatgagtaaaattaatttatcaactttactcattacacacgacgttgaagaagcgatcctcttatctgaccgaatttacattttaagtggcacacccgcatcaattacaaaggaaatcataattgattctgaactaaaaaaacaacccgatttcgagttgagcacgtcgtttctcgactacaaacgccaaattctaaacttattataaagtgggttaaaaagtcagcagtaaattaaccaaatcttttgctttctataatgttttagtttatattctagttaaagcacagacaagtttattcaaataaactgatttctaaagtttgcttgtgttttccaatatttttgattgtccaaaggagctgttagttatggcaagtgaaattgtattttttaatcctggtgattctttaggaaattttcatgattacaacgaagcagtccgtagtggtcaactataccggcataaggatgaaacgcctcatgaattagtgatcgcaacggatcctaaaaacgatgaagagtatctgattttttacgccaaagatgcggttgatcctgcgaataataaagataaacacggaaccaaatataacatctctaaacacttataaaagttactaccatactctgtgccagaaggaggactcgttatgacttttgcagaccaactgaccagtcaacgaaaacgggctggttacacgagaagtgccttagccaaagaactgggtgttagtcttaatcaggttgccaagtgggaaggtggcgaatctgagccaagtctaactatcttgcgtcagttgcattcaatctatgaaattagtatggatgaacttatcttaaatgagacaactagtcaatcggtgagtccttctcgctggctgacacgatttgataaagattttaagaaaaaataaaatctgtgatcagggtagttgaaaaactactggtgatcacagattttttattatcggcctacaggttgaaagtatcaaaattattatatcagtgcgttgcttgcaaagattagacttagtctggaagcaaatgggctcaatagtgtctttatcttagcgggtttcgcttagataaaggccgagcttggagacgtggcttgtggccccaagtcgtgccccccacgttccagcccaaatttgctggaagacggccttttaatctgattttattgccatgaacgttttcgtatcaagcaacaagataagtttttgtagtttcaaccttttattatcggtgtcacttgaaactgtacttctctatttttgaagcatttcataaggattcggtaaatgattggctaccttatcggctatcgctagggcaatttcgttagaaactgacttttcggcatctggcgccgtatacatattaattttataatcaacttccgctaaattttgttcaatctttttctgttgagccacaacttcctggcgatgtttaggcaataattcacgccgttgcttcactgaagctggtcccgccattacataatcaatgtatttgcgaatatctttaattttcatgccagtatttttcaaacaacagatggttttaaggagattcaaatccccaactgtaaattcacgataaccagccgcattacgtgccacgaacggtagcaacccttgtttatcataaaaacgtaacgtgtaaatcgacagattaactttggcagcaacctcttttattgtgtatgtcataaaataagctccactttttccttgccctagagtaatgtctagggtttaacatggctatcataacgtaaaacaataaaaatcacaatcaattagaggagagtcaaaaaatgacataaaaagtattagttacaggtggaaacggctttttagcactgcatatcatcaagcagttactcgaggcaaactactccgttagggcaactctgcgttcactcaataaaaaagaagaggtccttcaaacgcttaaatttcatgaggttccaaatcttgaccgtttaagttttgtccaagctgatctaacccgagatgataactggtcgacagccatggccggcattacttacgtcatgagcgtggctgctccagtttttgtaaatggtgaaactgccaccaaagatgtcgcccgtgccgcgactgatggcacgttacggattctaaaagcggcagttactagcaacgtaaaacgggttatcatgactaccaatttgggagctgtgggtttcagcaataaaaatcagcaacataccacaaccgaagccgactggactgatccaaacgagtccggtctatcgctctatgaaaaatctaaactcattgccgagaagagcgcctggaattatcttaaaaaaacgaacagtactctcgaatttgtaactgtgaatgcgggtgctatgcttggcggcgccttagatgatcatgtttcaggcagttttgggattgtccgtaatttaattaatggcactgtgaaacgcatccctaacatcaaaatgaatattgtcgatgttcgcgatgtggctgatattcatattcgtgccatgcaaacatctgctgcagcaggaaaacgtttcttagctgttggcgacaaaccgatttcaatgccagaaattgcggcgctcatcaaaactcaccgaccaaaattagttgctaaaattcccacaagaaccttaccaaactggataattcgtattggttctcattttaatcaacaggcaaaagaaggccgtttattcctagaagtgaaccacaacgttagcaatcagcgcgcaaaaacactattaggttggcaaccaatcggtagtaaccaagaaacgattttaaacaccgttgattctttaatccgcgctaatcaaatttaaatcaaaaaaagatcgatcgtaatttttgcaattacaatcgacctttttttaacactgcgatttaataaacatcgacattagcgccgaattcagcttctaaatcttctaacagtgtatgtttgtcggacttacattctttttcagaatacttaataaataaaacctcgctttatgttttgcctaagcaatcacaactatgcgagaatgtttactgtttttgaacattaacagcttgtggtccacggtcgctgtcttctacatcaaaagtaacttcttggttttcttccaatgtcttaaaaccgtcgccttgaattgctgaaaaatgaacgaatacatcgtcaccattttcgcggttgataaaaccaaatcccttatcagggttaaaccatttaactttgcctttttccatgtgaatgaatcctcctagcgcagtgcgcttttttaattttgtatcccacgagccaattacgaaaggagtcacgctcttagaacttcgaacccttaataaccaaactgataaaacacattaacataaccttaacaggaactaagtatgaatacaaatgaaacgacttctaaaaactcttataagtcgatcactctctattgttttgcatttaaaacccaggtattattaacttagggaagtgatttttatcatgaatagtttttttgctgtcttaatcgcattaagcattctgggttttatagtgttggaagctataaccctctacaataaagttacgcatcaaatgctttttcatgtaccaactactaaatataaaagttatattttaggtaccgtactgttattttgcgtcgccatttttggttttcaattcactaatccacaacccgtaacgtcagccccatctgtcaaaagaatttacaaaacaaaaacggttggcaaaaaagaactggagtctgctaaactacgggcctatgcgctcgcaaaaatatcatccaagatcacttctcaatcaaattcagttgaggatttgtcagataaggttgaatcggctaaaaaagcatcttcacagtcagtaaattcaagacaagaatcggaaagcaaacaggccaaaaaagaagttcaacaatcaagtgttgcctcacaaagttcaacacaagtttcaaattcaaccagcgccgacaagacttctaaacagggagatctagacacaaccaccaagaagagaattattggtaataaaaattcacgaatctaccacgttcctggtcaggcaggctaccatatgaattctcaaaatgctgtctactttcaaacggaagcccaggctcaatctgctggctatcgtaaggcaaaaagatagtaaggggagaaattaatgatgtttattggaattatctttttaattattggtctctttgctatcgtcgttgctttccgccaacgaaaagatcgcctttggttcgttttattagccgtaatcactttactgttaagttggaatcaagcgggttcttacgcgcgtcgaaaatactttagtgtgaatagtgtgatgtccacaaaagtcatcactaaggtaaattccagtgctaaagttttggccaactctttggaatctaaaaatagcaaactaaatcgtgccctatcctcccagtctgcctcgatcaaaaaaagggccagcagtttgcatattaattttgccaaaacacaatcaaatgcagacaagacgagtagccagacttccgatgataccgaattagccaacaaatcatacgctggtcaacaaaccatcaccattaaccaaaacaaccccaacttttcgactgccgatctttccaccagtaaaggtgcttggcaaacttatggtaatctagatcgctataatcgggtttcagcagcaaatgcacttctaaacaaaagtttaatgcctaaaacggaacgcgagtctttggatgtagaccccactggctggcataacaaaaagactagcaacggttggctgtacaatcgctgtcacttaattggttatcaattaacagggcaaaacaacaatgccaagaacttaatgactggcacacgttccctcaacgatcctgaaatgacaacttatgaaaatgaagtggcagactatgtaaaagccaacaaaaatcattacgtgcgctatcgtgtgacgcccgtttttcgtggaaaagaattagttgcccgtggcattcacatggagggccagtcgattggcagtaacgccgtccactttaatgtttatatttttaacattgaatctggttataccattaattatcaaactggtaccagtgttaagaaatgaggtttgagaaatgaaaattgtctttcatattgacgaaaactcaaagtggcaaactgccttgtcaaacgtggcaaatgccctgagctatgctaaacaaaagcaactgactatttccatcgtggttgtcgttaacggatctgcaatcactgagtatttggcaaatgatgttcaagtattcattagcacccatcaaggaaccgtcgaattccatgcttgtcaaaacgccatggctagtcaccacatttcagctgagcaattgcccaagaccgttaaagtggttcctgccggtgtgattgatcttgtgacgttacaagatcaaggttttcgttacattaaaccttagtattaaaaccttattttggagatgaccattatgaaaaaagaaagtttgcttttaaaaataattttattcttagttaccctcgcaattattgctggctggggcttcggtacttatggctttaccatagtgggttttgatttcaataatcattatgcctacgtcttttataatcttgccgttggcgtttttgcagcaggaatttttcttttgatcacgagctacctttgttttcatctcttacttgccattgataaaaatcaattctacagtagtttaacgtcaacaaggttggctcaaattagtcatcttttttgtgggtatctctgttgttgccattctggacctgcccgccttgtacgtcgtggcggatcacacggatgctcctggaattttgttgataggtattatttttgccggtgtagcaattacgttaaccattcttgcgcgactgttttctaaattagtaactgcagcgctcaccttaacaaatgaggaagcttaatctaacttttttgttcctatcgttttgtatcgtggtaagatagtaagcatggtcaaaaaacgaaaggcgaactagcatggaaaacaaccgttttactcaagacgaacaagtctcaaaaaaattattttatcaattgttggaactggaatgatgtcattttgtggcgtcctactcgagacctcaatgaatgtcaccttccccactctaatgaaacaattaggggtatcagtctccagcattcagtggattacttctggatatctcctaattgccgcccttgtcatggccctggcttcttatattcacaaacgattcaaactgaaaaatatttataccgtttccgtaattctgtttattttaggcttgctcctttgtgtatttgccaccagttttccagttcttttaaccggacgattaattggtgggatcgcaaccggcctcaccacgcctctcatgtttagtattatcaatcacgaaattcccattcaaaaactgggaagctacacagcaattggcgcgatcatcatttcaatggcgccaacaattggcccaacgtatggcggtctcgtatcttactactttggttggcgattaatcttttggatcgtccttcccgtttcattaattgctgctgtaattgggatcctaaacattgaacagcatcgtgataccctacgacctaagcttgatattttgggatttgcctggattgcagctgcttttatcttaattgccctagctttcaacgaagcttctactcatggttgggcaagcactggtttttggttaatgttggttattggcctgttagctgttggcttgtatgcttggcacgccacccataccaaatcaccgttaatcaatgttaaaatttttacataccaaccttttgtgttcagctttttagcttatgccctttgtcagttaattaatctgggtatgagtttcctactaccaaactttggtcaattagttttaggcacaaacgccttattagcagggtttttacttttaccaggaagtgtattacggatttttattatgccatggggcggtaatttgctagaccgcaaaggtccgtccttgccaatcctaactggaattggttgcatcttaatctaagccattttatttttatccttcatgtcatttttaacaattcccttgatgacatttttctacgtattctttagcgttgggttttcactcacgtacagtaatacactggcaaacgggatgaaacaattgccaatgcatttaaaagatgacggtaatgctgcatttaatgctattcaacaatattccggctcaattgggacttcattgatggccactttaatcgccattagtcaaatgaatgcaactggaatttccactaaacaggccattgctcgtggaagttcccatgatttcattttgctgatttttatggccgttgccatgttaggcattcaggcttggaatttcaagattcaaaaaaatcaaatcgtaaaataaagtttaaggcaagtcgaaccgaatcgacttgcctttttgtgtctaaaattagatttaacgtttcatgatatgataaattaagaaagaatttagaggtaaaacaatgcaaacagatcaatttattccaaacaacaaagtttctaagaagacaattctagcaattatcggaaccggtgtaatgtctttttgtggcattttattagaaacggccatgaacgtcactttccccacgctgatgcacgttttcggggtctcaatttcggccgttcagtggatcacttctgggtatttactggtagcatcccttgtgatgaccttatcttcttatatgcataaacggtttaaactcaagcaaatctttgcttgggcagtgatccttttctttattggcttatttctctgtgtcagtgccactaactttccagtcttactgattggccgattaattagtggtgtcgcaaccgggatgacgacccctcttttgtttggcattatcaatcatgatattccccttcaaaaactcggacgctatatggccattggcgccattattgtatccatggcttccgtgggtccgacgtacggtggcattattctttatagtttaggttggcgcgccattttctggattgtcctgccaattgccctaattgcgagtgtgcttgggttattaaacattgaacaaacgcgccctgtggaaaaaccacgcttagatctaatgggttttgtctggttggctggggtttttatccttatctctcttgccttcaatgaggctgctgttcacggctggggtagtttgaacttttggattttgttactcttaggcctcgttgccggtggtttatatgtttggcacgcccggcattttgcatttccattgattaatattactatttttaaataccatcgttttgttttaagttttgttgcctatgcgctttgtcaattgatcaatattgggatgagctttttgctacccaactacggccaattagttctcggtgtcaactccttattggccggtctcctgctcttacccggtagcttgttacggctgtttctgatgccttttggcggagttgttttggaaaaacgtggcgccgctcttccaatcatcactgggattagtgccactttgatttctggaatcctgttctttagttttcagtctattttatcaattccactaatgaccattttttacgcgttattcagtggcgggttttcgttaaccttcagtaatcttttgaccgatggcatgaaacagctgcctggcaaactaaagggagacggcaatgccgcatttaatgccattcagcagtattctggatctatcggtgcctcattgatggcggcgttcatttctattagtgaaataaacgctcacggcctctccacggtaagtgcaaccgcccgcggaagtcaaaatgattttcttgtcctgattggcctagaattggtcatgttagtgctacagattgttaactttcggaaagcacggaaacaaattggtgcaaactaactaaaaaatgcttggactaacctaactacaagtagtttgagccaagcattttttctttactgattcacgtttgtacttaagttaggattccgctgagctctaggacggctcgacaaagcaagaaagacaagataagcatgcctcccgcgggattgcgatcccgcatacgtcttttgtactgattttttccgctgagctctaggacggctcgacaagtcagtaagtaaaatataagaaggactcccgcgggattacgatcccgcatacgtcctccttatattttacttactagcgacttgtctcgcccactaatcttttttccaccaacttctccgcaatttgcaccgtattccacgctgctcccttcaaaagattatccgacactacccacatatggtaattgcctggattctcctcatccgctcgcacccttcctacaaatgtatcgcgctttccttccgcataaattggctgtggatacaactgcttctccggatcatcctgcaacactaccccaggcgccttcgtcaacaaccgctgaatcttctcccgactcgcgttcttctcatccttcacctcaaagtacaccgtctcgccatgaccaatacccaccggtacccgcacacaagttgccgtaaccttgatatcctttgcatccatatcatccaacataatcttcttggtttcatgaatcatcttccactcttcatgcgtatagccaccatcttcaaacacatcaatctgtggcaacaaattaaacgccaatggataatgcttctctccacccttcacaggatgaatcgtactcgtcattttttcgccatttaaatgctgttgcgcctgctcgttcatttcattccaagcctgctgaccagcacccgatgccgcctgatacgttgacacaatcacctgttttaaaccaaatgccttccgaattggttccaacgccaccaccatctgaatcgttgaacaatttggatttgcaataattccatgatgccgttccaatgcatcttcattaacctcaggtaccaccaatggtacctccggatccattcgaaaagcacttgtattgtctacgcagactgcaccacgttttacagcttctggcaaaagccgctttgaaaccgcacctccagcagatgctaaaactaaatcaacaccttcaaatgaatctggtgtggcctcttcaacaactaccggttcacctttaaatgccaactctttgccagccgaccgcgatgaagccaaaaatttcactgacttaaccggaatggtagattgctctaactgctgaattagccgtgttcccacggcaccagttgcccccaaaattgctacattgtattctctcatcaacttaaccttctcattcgcttttttgtcaattatgcaatagttgcgtctgcattcacaaaagcagccatattagtcattgcggcatgtaaatcttcgacacttgccgcataagaaattcgaatataaccttcaccaccaggtccaaacgcactccctggaatgacaccaaccttacctttcagggcaaggtcggtagcaaaatctaccgagttttgtgtatatctttctggaattttcgcgaaaatgtaaaacgcccctttaggaggaaccgtttcaaatcccaatttgtctaaacaaccaatgacataatcccgactctttttatactggacacacatttctttaggatcatctagcccgtttgccaatgcctcggcagctgcagcttgtgctggattagacggtgcggtgaccaaaaaggcatgcattttagctgcattttttataaagtctgccggtgcggcaatataaccaactcgatagccagtcatcgcatgcgactttgataacccattaatcaaaatagtttgttctggaatcattgaagcgattgaatgatgcgtcacaccatatgtaagttcactataaatttcatctgcaatgacaaacatcggccggttcgtaatcacgtcagcgagatcctgtaattctttttcggaatattccacaccagttgggttattcggataggtcaaaattaaggctttaacggcatccccctcgcggtctagagtttctgttaactttttagcagtcaacacaaagttatcttgtgatgtatcaacttccactggaattccaccagaaatgacgaccaaaggcacatataaagcaaaagcaggggtagggataattactttatcaccagggtttaacatggctgataaactagccgctaacgcttctgtggcgccaattgttgccacaatttctgttttgggatcgtagtctaatccatgccgctttttcaaaaagccactaatggcgttgcgcaatgcgggggttcctttttgtgctgaatagtgagaatcattttcacgaatactgcgaatcccagcttctttaacatgttcaggggtgttgaatccaggttcccctagcgttaatttaaccaatcccggcgtgcctgtaatcttttgatcaaacgcccgaattcctgagggtccaattgagtttagtttttgattgactgttccttgtagtgctgcacttaactttggcatataaccactccttaatttttacgataaaacattttctagaccaaccgttagttcctttaatgaaccaactttatgaactgcaatggccacacctttcataaaggaatcacgattaaacgaatcttgacgaattgttagcgcttcgccttcgccaccaaacaaaacttgttcatgagccacatagcctggcaaccgaactgaatgaattcggatccctttataattagcgcctcgtgcaccctctaacgtctctttaaattctggggcatcattggcctcgcgaacctcactaatttgtttagcagtgcttaaagctgttccagaaggtgcatccaacttatcttcgtgatgcatttcaataatttcaacatctgggaagtaagttgccgcttctttagcgaatttcatcaacaaaactgctgaaattccaaagttaggaacgatcaaaccggctgtaccttgttctttagcataggcttttaaatcagcaacctgctgatccgtcaaaccactagtcccaatcactggtctgatatggtttttcaatgcaaatttagcattatcaaacaccccagcaggcgtactgaaatcaatccacacatctgcttcgacaggtttggtcgttaaattattgaaaatctggacatcctcatctaatccataacttgcagaatttatatccgttgcgtcaggactgaatgccccaaccaatttaaaatcctcagtttttttgataaggttgagtgttttttgccccattgatccacgaaaacccgctacaattattttaatcatgattaactcctaactcggccaaactacccttgttttctaatgcatcctcattcaaatccaaagcttttgctaacgtagcccgttccgctttgttcaaaggcaaaattggtaaacgacatccgccgacctgataaccttgtgcggttaagacagcttttacaggggatggtgaaggatacaagaacaacgcctgcatttttggtgttaatcttcgttgtaacttgccagctaacgcagtgttacctgcataaaaagcatctaacatttggcgcatatcttggccataaacgtgggctgccacagaaacaacccctttagcaccaatcgcaattccaggtaaggcttgggcatcttcaccggtataaaccatgaaatcatctggcgtatgttccactaaaaactccagatcttccaatgaagtacactgtttaacagcttgaatattaggatgttgggtaagtttaacgaccgtttcgtttgccatcgtgacacctgttcgaccaggaatattataaatggccactggaatcggcgaagcatccgccaccgttgtaaaatgcgcaatcatgccgcgttgatttggtttgttgtaataaggaaccacaacaagtgccatatcaatcccttcaatttgaccaacttctttagtcaattcagtagtttgtaaagtattgttgcttccagttccggcaataacaggcaccctgccattcacaattttgccaaatttcgtatataattcaattttttcatcgtgcgttaaattgggcgtttcccccgtcgttccgccaatgataaagccatgactaccagtttctaataggtgattggtcaacgtttcaagggcgtcaaaatcaatgtggttttggtcgtcaaatggcgtcacaattgcggttaaaatatctgcatctttaaacatccgtatccttctttcctaattttcttttgtttgcattcgatttaatagaaatcctttaatagcctgaatgccaatctcaattgcttttggattaggctttaatgtggctgaatgaagttgagaatcatcgtcaactcctagccaaaacatggttcctggaaatttagcgagcaaataaccaaaatcttcacctgtcattgcgggtttcgtttcaacaaattgcacatcttctgtttgtttcatataggtaataaagtttcgagtaagtttcgggttgttttcaactggccaatagccgccctgattaagcttcaccactactttggcctgataactttgcgcaatgccatccgcaacctcttgaattcgctgatcaatatgttcaatcatcttttgtgttaacccacgaatcgtgccttccaaacgggcatgacccgcgatcacattgcgaatgctaccagcatcaaatttaccaaaagtaatgacgccgccttcaattggatccacactgcgggaaataatggtctgcacttgattaataaactggctcgcagccaccaccatatcatttgcatcctgtggaaaagccgcatgaccacccttcccatagaaatccacgtcaacttcagtggttccggcaaacaaagtccccatccgacaaccaatcgcaccagtgggtaaatcaggattgtcatgcaatccgtaaaactcatctggacaccatttaccagtgaaaatctgcttttcataagcagttttgccaccgttcaagctttcctcagccggttggaagaaaaacaacaagttatctttcggctggttagctgcaaaatagtcgagtaagccaagtgcaacactcatatgaatatcatggccacaggcgtgcatcacattgggatgtttagaagcaaatggcaatccagtttgttctgcaactggtagtccatcaatatctgttcgatagccaattgtccgttcagatgcactcccgtgaactaacacgagtaacgcggtcggcatttctgccggagtttgaatttccaaattagtttggtcgaactgaagcaccgttcttttaatgaaagcatgggtttccgtttcttgcatcgcaagttctggaatctgatgcaagctttgataaattttgattaattgaggctctgttaacattgcttgtttgttcataactttacagctttcttaaagtgtcctcgagttctgtctttgaccgagtttggtcatcaatatctttcattttgcgggcaggcacaccagccaccatcgtgtatggggcaacatcatgcgtcacaaccgcaccagcagccacaactgccccttctccaacgtgaacaccttccaaaacaacggaatttgccccaatcatgacattatcatcaatgcgcacgggttgggcagacgccggctcaaccacgccagctaaaacagttccggcaccaatatgagcatgttttccgacaatcgcacgaccgcccatgacaactcccatatcaatcatggtgtcttcaccaacctcagcgccaatgttgatcaatgctcccatcataatgacggcattgtcaccgatcacaacttgatcccggataattgccccgggttcgatgcgcgcattgatattcttagtgtccaacaatgggaccgctgaattacgtccatcattttcaacttcataatcttcaataactgctttgttgttctcaagaaatggtttaacatctgcccaatcgccaaaaacggttccggttttggtttctacaaacgctcggacgccttttggaacatcaagtttagtcaaatcgccttttagagtgacctttacgggtgtttttttcttggcgttactgataaaatcaatgatttcacgtgcatctaactgtgccatggataaaatccttcctttatataaacttttttatttttcgttgtcaggttatcataaggctcaatggttatttgaactttaaaaattctcgattcttctatattatatggcattcagcaactaaacaaaactgcaatccagtttgaccaaatcttcataactttctcgtttaacaatgacttgtgctttacctttttcgacaaacaccaccgctggccgcggatttcgattataatttgacgccattgaatacccgtaagcaccagtagctggaattaccaaaacatcaccaggctgcgatttaggtaaggcttgtttttgaatcaaaatatcgcctgattcacaatatttacctgcaattctaaccgtttcatctggtttagccgttgcctgattagctaaaacggcttcatatttggcctcataaagcgccggtcgaatgttatcgcccatcccgccatccaccgtcacatatgggcgaatgccaggtacttcttttcttgagccaattgtatataagctatatcccgcggggcctgcaatggaacggcccggttcaatccaaatggccggcatttttagctgacgtaacgtgacctgcttttggacggccttcacaattgcgtcaacaaattcttcgggtgccagcggatcatcttctttggtgtactgaatcccaaagcccccaccaatatttaagactcgggtttcaaagttaaacttcttttgccagtcagcagccaaatcaactaatttttgggctgccatgacaaacccattaacctcaaagatttgtgaaccaatgtgagcatgaataccaagcatctctagttgtgaatttgctaacacctgctgcaacgctttttgcgcttgcccagattgaatatcaaagccgaatttgctatcctcttgaccagtttggtcatacttatgggtatgcgctgaaacaccgggcgttaaacgtaacatgactttaattgtctgttgtttttctttcaagatttcgcttagtaactcaatttcgtgaaaattatctaaaatcacaaccccgatatgatgatccacggccatttccaattctgcgcgtgatttgttattgccgtgaaaactaactttttccattggaaagtcagctttgatggccgtatataactcgccacctgataccacatcaatgtgcgcgtcctcttgattgacaagttgaaacatcccaactgtggcaaatgctttgctggcataactcacggcgtaatcgacttgattacgctcaaacacctttttaaaccgccgaatttgttggcggattgctgagacatcataggcaattagtggcgtcccataagtatgcgccaattctacggcatcagccccatcaatcattaaatgtcctgcttcgtttacttgttgctccccttgagtacccatttatttaccccactagttttataattattttattaaacaaaaaagagacctttttgtttagcgcaaacaaaaagatcccagaatgagttcattattattctgtatcaattgtcgatagcgccccgcagccgacatgttttgctgcgacagtccgcagtctgttaaactacgtcccagcacaccaaacccctatccagatttgacgcttcggcaaccgcccctttcactagcttcataatttgatagaaattccactaattacccttgttggttgcgacctcttaaattattaaaaagtttataatacttctcacagatggtcaacccctttactccaataaaattccctgtagctcttttgtatcagttaaaacaactttatctccatttaatttagagctgctaatatcgagcttgtttagttctaacattgctttcacatgtagttttgaactgcggccagccgcattgttttcctaaatcaaaaataaaaaacttactactaagtatttcttataattgattaattcaaagaataatttagttgctattcatcaaaaaaatgctaaaattcacaataactaatcaaactttaataaaatataatttttgaaaactagaaaggatttttttactcatgaaggttgttaaatttggcggtagctcattagcagacggcgcccattttcaaaaagtcatctccatcattaaggctgatcctgcacgacagattgtcgttgtttccgcaccagggaaacgattttctgaagatacaaaggtcaccgatctcctaatcacctacgctcaaagggtaatttatcatcaagatccaaaaacggttgtggataaaattagtcaacgctaccaagcgattagtgatttctttggattgccagctagaccaattgacaaaatcatcaaaaagcttcggtcactaccccttgaatattatccaagcaacacgtatttgatggctgccttcaaagcgcatggtgaacgtcttaatgccatgttgttaaccgccgtgctcaatcatctgaacatccctgctcgctttgtggatccttttgaggcaggaattatcgtaactgacgatccgagtgacgcctctgttttaccagaaacttacgaaaatttagcgcatctaaaggttacagaagaaaaactaatttttcctggtttctttgggtttacgccgaatggccagattgccaccttttcccgcggtggttccgatatcaccggcgcaattgtttcccgaggactaaaagccgatttatacgaaaatttcactgacgttgatgccatttacgcggccgatccacggattgtagatcatccccatgccattaagaaaatgacctaccgcgaaatgcgcgaactttcttatgcaggtttttccgtgtttcatgatgaggcaattattccggcaattgaaggccaggtcccaatcaatgtgaaaaacactaatcatcccgaattaccgggaactttaatcgttccagaagatagttttgagccccaccgcaccatcacgggtgtagcaagttccgatcgatttgcggctctatatctgcaccgttacctgctaaataaagaagttggttttacattaaaactccttcaaattttatataaatatgatgtttcttatgaacatatgccttctggaattgatgacttaaccataatctttgacaaaaaccagttagacaacgaaactattcatgagatgtgtcatgacattaaaaatacgttgcatccagatcaacttgattggattgatgattatgcgattatcatggtggttggtgaaggtatgcggtcaaaagttgggacaattgaaaatatcatccgtcccctcgctgaaaacaacattggtgttcacatgatcaatcagggtgcttcacgaatttcaattatgttaggcaccaaacaagcagacgccaaaaaagccgtcaaacaaatctatcaacagtttttcacatgtcaaactgacacccacgaaaggagcactactcatgcagattgataaagttcatggttccgaaaaccacttctttttactcgatcaaactcagctacaaactaaattaactgaccaagaattaattaatttcgccacaaaaattacaaatccgcaaaccggacttttacagggagcagatggcgttttagtcattgacgagcccacgcacgaaacggccttggcccagatgcgggtcattaacgctgatggcagtgaagcctcaatgtgtggaaatgggttacggaccgtttcccgttatttaagtaaaaaatttcaggtagaccaatttaaagttcaaacgcttaacgccgatttaaaagtcagtaaagcaaaggattttgcgccaaacgtgcccgcatttagtgttgaaatttcaccagtctcatttgatgcggaaaagttaccgtttcacaatgcaaaccatcagcaattagttgacgagccatggccagaactactaccagaactcaaatttaccgcactcgcagtgcctaatcctcatttgatcagttttgtctctgctgaagaattagcatctgatgacctagggactttagggaaacgtctcaacgaacccaacccttactttccagacggtgtaaatgtcagttttgcggaaattttgggtcaaaataaattatttgttcgtacttttgaacgaggagttggcttcaccaatgcttgtggaaccggcatgtcagctactagtttggcatttgccctcacccatcctgatgaaggtcagtttgatcaagaaatcaccgtttataatcccggtggcttagttaaaaccaacgtacacaaacgaaatggcatctatgatattgatttaattggaaatgcgacggtcacacatcaccttgagatttccgaagctgacctgcatgccgctaaattaactgatgttcaaatcaacaaaacggatgaagaaacaagttatcaaaaatttgtgacacaattgccaaaaatcaacaatatttccgttaaatcataaaaaaagaggccggacaaaaactatgttttgtccggtctatttatatttccccaaatattatttctaaaacgtgggaaaaagcagattcttccgcctatcttcagaatctaacgccttttgtccactttttattttattgtttttgatgagaaaccttctccaacgtccaaccagacattaaatggaattcatagtcttggctgacaaactgcttattgggaacgccattgctaaataacaagcgcatttcctcgtttttataaacgcgtgttttacgagtaatcttgacttgattcaacttagaatttcgtttaattttggtagttccggttgtagggtccgtcttagccagtttttgctgcaatggatttgtggcgtaataataaattcgctcatccttggtaccaatttgttgatacaagatggcatgtttgcccttcacacttgaggtcaacggataagtttgcgtttgattaacttctttcattcctaaataaatattgtagtttaacgcgattaacacgacactcccaatacttaaaataagacccaaagttacccaaatcattttattaataccacggtgcataaaaatcatgctacaagcaaaaaggattgcaccagcgaacaaaaaaataattatcatgttaatatccccctcgtgcatcttttttcaagaagaacgttaatagaaaaccaagtaccgcaaacattgtggcaattaaaaatgcgtagcggaatcctaaaacattcgcatttaaagcaagttttttaaataagataggtgttgcttgtgaaacgccgctgcctggggtgtgagataacgtcacacttgacatgatggaaactaaaatggctgttcccatggaagcaaatacctgacgggccgtattattcacgaccgttccatcaccaatcaaatttagtggtaaatcgttcattccagttgtcgtaactggcatcataaccattgaaattccaaacattcggactgcatacaaacaagttaaataaaacactggtgtttgagcggtaattggaataaatgaagctgtcgtcaaaactagcagaaacatccctgcaattgacatgtttcttgcacccaaacggtcaaaaattcgaccggtaattgggttcataacccccatggcaatggccccaggtaacagagttaaaccggacgctagcggcgattcaccacgcaccgtttggagataaaggggcaaaaccaatgtgaatccattcatggacataaaggaaacagaaaccaaaattgcagacaaggtaaagtctgaatgttcaaacactttaaactgtaaaagtggatttttaattttaagcgaccgtaaaataaaaatagcaactactaaaacaccgacaatcaaggttccatagacaattggattagtccaagaataggttccaactgatgaaaacgcaaataacattgaaccaaaaccaatcattgataaaagcactgaagaccaatcaacaggtgcttttttagttggcaaaacttttcgtaaagtaaaatagcccgcaaccaatacaatgaaagaaatgggcatgatggacaagaacaacattcgccacgaataatgaatcaaaatccatccagcaaatgtcggcccaatggcaggtgccaatccgacaacaatgccggcacttcccattgctgcgccacgtttagctggcggaaaaattgatgtcataatggtctgataaactggggatgtgatcccaacaccagccgcttcaatcaaacgtccggctaaaatagtccagaaattttgggcaaaataacaaaccacagttcctacgaaaaaaataacaatcgcagataaataaagctttcgcgaatcgaaacgttgtaagaaaaagccagtgatgggaatcacaattcccatcatcaacataaatccagttgttaaccattgaacagtgtttgccgagatattaaaggacttcatcaaagttgggaaagctgttgttaacatggtggacgtcagaaatgtactaaaagtcccaattaatagggtaaaaactaataaaagtcgattatacgggcgaccattttgatcgaccggtttatcttctgcattaatactgttcatgaaaatgttcacctcattaaattatttaattatgtacctataaaaaagtcacaaagattattgtatcatataaatctcataactctcaaagtgttgtttgcaaaacagcatgtccacatggaaactatttaatgttggtttaataaatcgctactagcataacaactagcacgcaaaaataaactatttatgataatcggtttatttactcgcaaaccgagaataaatagttgtattttcaactgaaaagattgtatgattgttacagttaaattacaaagatttgttaatttagcggatttccgattgacatcgtttagccacccttctatagtttagggattgtgactatctgaatcgtgaatcaagttccttcaaaaaggattcaatttacgttatggggatcagattttttaacaacttagctacatattatgaggaggaaaaaaattgattaaaaataattggttaagatgggtattactcggcttggggatcttaatcgttggtggcggagtgtttgcctggcaatatggtcaaactcattttgcccccaaaacaacaattaatggaaaatctgttgctggactaaccgctaatcaagctacccaaaagttggcatcgtcttcctcaactataaccaatcgggtttatttaaatggtaaactgttggttaccggaaaacagcagacattagcaaatgtcaccaaagcacaagtaaaaacagccctcaaaaatcatcacgggttgtttgccaaaaaggctaatactgttgatttaacaagttccgatgaggttgttacttaccgaagcaatactttggaaaaacaagtttcagacgccctgaccgcctataacaaaacggctactgcggctcatccaacctattattacttgaaagacggcaatatcaagacacaggctgctactaagggtactcaagttaacgtcaccaaagcattagcgagctataaaaatcaaattaagcaattaaaagatataaaactaaaaacgagttcctccacagcaaccaaggctgaaactgtggctgccgaaaaggtcaaacaaaatttaaaggacagtttaaccaaaacgttggtctatcacgtgggtggtaaagactacacgttaaaaggctcagactatattgtaaacacgaaacctggtcaaacacctactgtagatttaacggccttggaagcgaaactgaccaagatcaacaactctgatagtactcagggaaagtccttcagtgttaagcttttgaacagtggcaaaacgatcatgacaaataacacgactgattcaaattacggctggtcattaaatgtgaaatcagaagcgaagatgttagctgacaaattcattagttcaaccatcaagtcaggcaccaaggttgatatgaagaactattctggtcaaaatatcagttataaccgaagtagtgccattggttcaacacgcgttgaaattaatttgaccaccctgcatgaatatatttatgtaaatggcaaacaaaaagaagatatccctgtaatgagtggaactttgagtggcagtaataagaccccgaccggcctattccacattctctataaacaaagtccttctaccttaactggtaagaacgataatggctcggcctatgccagcaaggttagctattgggaacctttaactgaagatggcgtcgggatgcatgatagttcatggcaaccttccaaagtttatggaaacccaacttaccgtagcacgtatcattctcatgggtgtttaaacaatccaccaagcaaaatgaagtctgtttgggataataccactactactgaaccagttattatttataaataaaacaagagtgttgagaaattcaaaattttcaacacccttttttgtttaccatcgataaatattttcaatgtttgtctgtttaaataaacacccaccatttttgacaacaaccttgttagaagcttcattatctttattaactgaagcttgaactggcgaaacttgtaacttctcgcattcttgaagaagcaaagctaacaaagcatttccataatcttttctgcgctcatttttggcaattgcataggcgacattaccaccagactcaagtaactgggcattaagacgaaggcgaactcttccgatcccaactggatgcccgtcccacatccagtaagtcacttgtggcaccattttttcatcaccaaaactaggatctgcttgtgtgtcagcttcaattagccactgtaaatactgttcataatcataatctttaactttgttttcgaatccattttcaaatcgaccaatattttgtaacagttgatagtacggttgaccatcttgaggtgttaatttgattaacttcataatccgaccttcttcggcgattaatttggtaacgataatactgtctaaaatcttcaataaccttgtgtttatccatatatcccacaataccgatatcgtgaaaatattcatgatttatattttcatcactttcaacttgttcttgcaattttcggaatttttatgatttacccgtatcgaatattattagtcttccaacagcttttccagtgttgtttttaacaactcagggtcgtatgaaatacttttactttgcaataaattagcataacctatgataaatatccagatttgaataaaaaaggaatttttatcaatgcgtgaatgttcatctaaaactgctttaacgttaagaaaggttaagttcaataatggccatttagctaactcatcatcggaaaaagaaacaactggcgtttccaatacaaagtgggctaaatttggctgtgccacaatcgttctcatcaggttgtctccaagaaataacaagcgttcagttgccaatggaatcccggccaattctggttcaataattgctgcccactctgaagaaaccttattggctagctccctgaaatagacttgccgattaggaaaacttttatagaaagctcctgtcgttacgccagcttcatgggcaatttgccgtaatgttaatttttgcaccgaatttacttttatcaaactgatcccggcattaattagtctatctcgtgttgccgttttatttttcatcacatgcctccacaggtaaatataacgctgttatctgcatcaaacaataggtttgaacaaacactatccttacagcttaaaactcacattaccgcactcatctgccacatcagttgttatctttaaacccatttaataaacaattaagaattcaattaacctcttgttaagaactccacgacatactaaagataagaaatcaggaggaggcaagaaaaatcatggaagacattttaaaacttgaccaagtatccaagaagtttggccggcaaaccgttttaaaagatgtcagtttaactattcatcgtggcgacatctacggtttaattggtcgaaacggtgcagggaaaaccactattctaaaaacaatcattaggctgattcagccgacacacgggactatcacactctttggcgtttcaaaaggttccgcatacattcaccaacttagccgaaccgggagtattattgaatctcccgtcgctgtcgatcaattaaccgctcgtcaaaatctaatttattacagtaaaattcacggcgtagtcgatccctccgcggttgatgaaacccttaagtttgtgagccttaacgccactggcaagaaaaaattcaagaacttctcgttaggtatgaagcagaagatgggattagccattgcacttttgaacaaaccagattttctgattttggatgaaccaattaatggattagacccaatcgcaattgttgaatttagagaactacttttaaagctaaatcaaactcaacaaatgaccattctcatttcaagtcacattctggaggaactttatcagttagccactcgttttgggatcttaaataatggcacaattgtcaaagaaatcacgaaacaggaatttgagcaacagagccgggaatttatcaaacttgaggttgacaaccctgacttggcaacaaacgttttacgtcaactgggttgccaaaatttcaaggccatcaatgaccacctgataaacatttatcaactcgatatttccaatgcaaagattaccgaaaaattaattaataatcatgttcaagtaataaccatttcacgagaaggcttaaatttggaacagtactttaagcaactaattgaaggaacaggagatgagcaacatgtttaatatgattcgcggtgatacttatcgtttgctacattcaaagggattttatatcactgaatttcttcttatcattttagtgctaacttctgttttgaccggtacattaggaactgttggtgttcaaacagaatctttagccaaaatgcaagatgtgacatctgtttggaacaccgtcaaagcgatgaagttaatgactataatggctagctttttaatttatctcattttaccgctcttcatcatgacaaccggttttgaattttctagacggtcttataaaaatttattaagtagcggcatgacaaggttaaattactttttttcaaaatatgccgtttttatcatgattgtttgccttcaatttattctgttttatggcactacttttttaggaactggcttaaaaaacggtttcggtacattaatggcaaactttggtcttaaaatttcacagactattttattacagatcttgttcataattgccattttttcagtatcaatccttgtccttttcgtcaccttttcaaccatcacggctgtgaccacaactatcatttttccgcttctcattcagattatgagcgcaatttttaataaagttaattggattaaatatttcgattttcaaagcataatcgataatgcctacttcacacacctttcagcacaaacactaacttattatattttggcggccagtggtaccattctaatttgcggattcctatcaatttatgtattcaaacaaaaaaacctgtgatgatgattacaggttttttgctttatttaagtcccacgtatccagttttattgatcagtttctggccttctttacttgttagccactgcaccaaccgcttactattttcagtttgatcacgacgactaattgcgtaaacgttagcgataaatggatacttcccatttcgaatatttttggtagttggcgcatacccatttattttgagcaacttaacgttcttattttgtttcatttgcgttgtatagaatctaaatgagtagccaattgcattcgtattattattgtaaccggcaacgtcatcaatcaaaccgcccatgccatcttcttcttgatagcgcatgggtgttgccattttcttacccttcatgaccaaaccttccatcgctgtttggctaccagagttcttggaacgttgaaacgcctgaattaatgttggtttgccaccaacactcagccagctgattgtttttctttgataaatggcttgcacctgttttacagagagattattcactggatttttcttattcacaagaaaaacaaacgcttcgctcccaagttttgttaagttaaggtgaatatgcttctttttggccgccttaacttgctcgctggaaggtgcggccataaagacgacatccgcttttttattaatcaaactattaaaagccttgggagtcgttcccacttgaataatcttggcagcctgcttggcattgagaccagaatagatggtttgcgcaactgccgaataaatcggataagctgcagttgcgccgtttaatcgcggataatgaacagcaattttcaagttggctggctgattcaaatgcgccaattttttatcatctctgaaaggtcgatactggttcaaatttaactcactggaattgctggtgtacgtatccacataatgctggcttcgaattatatgctgatacacaggcgctagactaaccaacaaaaggaccacgaagccaaccctgtatcttcttggtagtttaaagaaatgcttcaacgaaagactgtcccaagtcacacccaggatggcagaccaaaacgccccaatgaaaaaccaagccaagttgttgtataaagctagtccactggcaaacaaactcgccaaattatagggcatcaccaacaacaaggggtaaagttccggaatttctatgtaattgaagtcaaatagccacatgactacgacaaaaacaccaagatagtagagtaacgcaatcaaaagtgcgcttacctcaagtctaattttatttttgaattcatattttttattgtagtgatgccaacttaatccgttaaggaacagggctgggatcaaagcccaccaccaacccaggccaaagacacccactgacccaacgattagcggtgtccagacaaagcttctaatcagtaaccaacaaaaactcgctcgattctttttccttatcaaccttatttccctccagtacagttctttaatatctaatcatttacaagttattcttggtaaactgcaattcaattgtaaattttgtggccgtagtctcaatcgtaaccgtccagttcagcaacgtagtcagtttttttgtgatatataaacctaagccggcattttcagatttacgggcaagatcctccgtgtaaaaacgattggttagccgttctggatttttgattggttgcgccaacttattggaaaaagcaatgcataactgctgatcatctccattaagcgtgatttctgctgcctcagttccatgctccaaaatagttttgaaagattcgttgcaacatatcacgatcagccacccaccaacaattggattgaagattcagttttagctcaatttttttatttgtaaaggcttcgtacatccccaaaatcatttcctgaagcatactcgtgatgttaattttttgaagattgaccatcaattcatgttcattcaaccgattgtacattaaaagcagatctaaatgtttggccacactgttcagattctgctcaattcgaaccaaactttcatggtcgtcaccgcctatagctggttgtttcaacaaaacttgcgtataaccgctggcaatggtaagtggcgttcgcaaatcatgggcaatgttatgaatggccacatcttgtgcgttctttagttgataaagctcccgttcgtttttccggtgcttgattaagagttgattaatcttaagcgccaaatccttaactaaaaaattgcgtgaatgtaatttaagttcttgattggtgggatcttgcacaattgaatctaattgtttgaccacgcgactaacatctagtaacacaaaaaataaatagagactgaaaaaagccaacattagaataaaaatcactaaaatagtcatgcgagtttcaccccaatcccccaaactgttgcaatatagtcattctccggatctaattgttgcagcatctttctcaaattactcaaatgcacgttcattgtattatcatcatcgtaatagtcagcctgccacacggctcggtaaatctgttctcttgtgaaaacttgctttggatgcttaaaaagcagttttaaaatttcaaattcctttttctttaacaaaacagtctgggtaccattggttaccgaaaaaatatcagtcagtaacgtgatatttttgtatgtaactgatgcattttcttctggactaatatggtcgcgcagctgtacccggattcttgcctgtaactcctcgatatcaaacggtttaatgatgtagtcattggccccggctaacaaaaactttgccacatcagcacgcgcatctaaggcagttaaaataatcacaggaactgccgtagattgcctcaattcttttaaaacttcatcaccattcttacctggtaacattcgatcaagcaaaactaagtccacttgattttcgttaaagactaacaacccttctgtaccagaataagcacttaaaatatggtaatgggtttgtaaaacctttttaagtagctgttgcatttcgtcattgtcttcaacaattaatactgtctccatgtgaccaccccctgcgcctttactatcattatacccgattgaagcgctttcgatacgtcaaaatcagttttcgaaactgtacataatattggcgtatttaacctttagttgcctacttaatcacaaacaaattctgcgacggttaggaggtgcacgtacgtttcagtttatatttgctccgcttcttgtggcaattcttaattcattatttgtctattagttgaataggcaccacaagccgtgagcgttaggcaaccctcagcccacccgcatcgcataatagttgccgaagaaactatcgtgttttaaaaaaatgcgcaaaaaacacccagactaccacaaatagtctgggtcttggtgtacctacgtttcagtttgcttcaattacagtatacttgattggtgtaagaattcaagcccaaaacacgcatttttcaagccattttaagatgatttttagttatgaggccagtgcaatacacagcgctatttgatcataattatttagatcagtctatggcctattagtgaattactgtctgacaacaccatatgaaccacaaaatctggcagtgatttcaaatgtcacaattcttcatccaaaaaaatcaactacgaaagttgatttcaggttttataaattaaattttagattcttaccatgcaactactttgagttcaggccatttagatttccacttaatcgctttattcatatagattgattccgtaatcatttttttattaggacgcacaattccactaaaaacatcattcaagccataaggtgcaaaagcctctatatcttgctgtttattaagatatacccccaaaaaacttgcggtagttggccatgtactaattgcatcctcagtgcttacgtaaggatttatcttttgaccgaatctatgctgataccaaaggtgcacacgagcctcatttttaacatctatattatatttcttcaaaggaagttcggacaataactgattgcgaatttcattttctttggcttcgcttaaatctgtatcaaaataaacaatatcaaggtcactaataccaaatcctaagtcttttgagaaaatctggttccacactgactgggtgatactgccgccacccacataactatttggtaaattcaacttggaaattgtccgaagtacgttatatagttcttgatcacgcatcaatatgtcattcagcagttttatttgcgcatttaaaggtacattcactccactttgcatcaaaacactcctccgcattcatatcttacgcactaagtttttgtatgaaatttcgataaacagctgaagccgcattacctgggctatctggaaacataaattgaggcgcttttccggcagcaatccattctgctgatgccaattcatcagataatttcaaattttgtttcgccgttttaccaataaaaccatgcattaaagcattgttctttccaaaccaatacgtccccgaatattcaagcctgtttaaactaagacctagttcttcttgcacctcacgtttagcagcagcctctgcactttcgccaggttgcatgtatccagaaatgaacgatgcataacggtgcgataagtaaggcattttggccaacacaatttcattatattcattagctacaagcacaatcacgcaatcggaaaaagtcggaaaccagtaacgatcacaatgttcacaatacggtgttaacccatcgtcaccagcagccttatcaactaatattgtgccacataccgggcaataactgtatttcataagacttcagcctccatgtctattttggttcttctttactcttattcattcttctaaatttaagctgtgcgttaatcctctgtgctgtcaatcgccaataagtgcgtagtgcgatccaaatacagacatatataatcatgaaattaatcaaaaaaataactaaattattgccaactaaccaattccaatgaaacaaaagattaaatccactcacgctcaaaaaagaaactataatcagaatggtcaattcaccctcgtcgatagcatcagcattgaccttactttaataaactaaatttcttagttaagtttcgaaccactgtgtcttctccactgattgcaattccaaccggatcggtttcctctagtttactacttgaaattttcgctgcatattcttcaaattggttattaagtgattgacccgtagctgtgaacacaacactcaccacctgatcgttggcagtcaagcttttagcgagatttgcaatttggcctttgccacctttcaacaccactgtgctgtatttaatacctgcatgaagtacttggtcttgatcaataactggctgctctgaaaatacggcagggtctaatttggaaatttggcccattaatatcgcggccacattaccaacttgaccaatagaaagatttctatccaaaattattgcatttctcttcataagggattcacctcgttcataagatatacatactatacctattgttggtaactaaaactagcaaaagttttgtttgtccaaacaattcaaaaaaacagcctaaaccatttcatgcaaaatttttgcgtaaaattggcttagcctgttttttatcagtaatttattatttattagaaactagttatccgcatctgtatcgtcatccaatcgggcttttaaaacttcaatcgcctggttagtcgtttcgatctcttcaatcacttccgacaaagtcagaccctcggagctgtagcctttgtacgtagcagtcacgtattcgttttcttccaattggcgaacacgttccctcaagttgcccaattcttcaatcatttggtcgtattcacgatcggtcatttagcctacctcacattcatcgttttaaccaactattttcctaagctaaagcttctggtgcatccaattggggacctttcccttcacgtgccagcacccaatcatcatagttccattcttcagttgcccgtctcgaacgcatatagtcccactccgattcacgttcaacttccataatctgcccaccaggcccaatcgtcacccagttgtaggaaccattattatgggcaaattttatccacagcacgtcaaaatcgattcgttttcccttgctagttttataaaatcgttttaatctgtcaattctcataaattgtaacccccgggcataatctgcgtccaaattctcccaaacatcggtggcaagttgcaccagattgttttcagatggaagcggtaaactagggtttccaaaaaaattattgtagctaatcaagcgaccatcttcaccataaactaaggtcagatgggcattattggaaacgacctctttttcttgttgataacgttcaacgcgaactttttcacgattgcgctgtcgttgtgtcgaagaaactaatttaaattcatcaggaattattagatcacgatcgatttgattcttaactaatacatactctgtcatatcactcacgctccattttctctgcaaactattgagttttcaatctaataacgcatccaatccagtttccattttcccaactaactgtttcaaaaccacagcttctttgggatctaacgtttcaacgactgcttgattaatcgtcgggaggcaacggactaattgatcgtacttttgcgtgccaagtggcgtcaacttgataatgcgcgtacgaccatctactggtgatttttcttttgaaatataacctaatttgatcaaccgatttaatcgccgggtcacattacttggattgaggtaaatttgtttaaaaagctcttcttgcgataattcgcccatatcgcccacttttagcacaaaaaagtaggtacttgatgtcaaacccaaatcctttaactctttattcatatactgactcaccttatgtgaaactgtattaattgccctaaggtaactatctaattctctttttgccatgtttgaagtcctttcgaatcgcgtaaattatataaagcagtgccatgcctaataacaataagccgaccgcatatgtccaacgttgggcaactaaaaatgaacttttggacacgccaattgcggtatctatttcgcgatgattgatgatagatagcacgcgataaaaaataatggtcgacaatgttgtgcctagaactaaaccaaattcgcgcactaatgaattggttgaaccagccattccccgtaatttttcaggtaccgactgcatgataatcacactgttgggggtgccaaatgtggccgttccgacagccatgatagcagaaagcccaataaaataaagcggctcggatttcctagttaaaaataatagtccaatttgagtcatcataagaatgctcattccaatagtcatttccacatgttggtcataatgatctgaaatgtacccggccattggggatgcaaacactgacacaacgggagcaaccattaataaaatccctgagaattgcgtggaatagtttaaaacaagctgtaaatataacggagctaaaattgtaaaaaagtaagagacaataaaactcaaaaacacgacgataatgctctttctaaacatctcattgcgaaaaattgtgaagttcaataatggtcgcaatgctttttgttctgttttgacaaaacaccaactgaaaccacctaacaggatgagcagtcccgccaaataggcaatgtgcgtattcagctgagtggtcaacaaatataaacatgtcgcagccaaagcaaggagaattgcaccataccagtcaatccccttttctttatggcgtatacttttcgggaaaactaaaacctctataatcagacaaattattccaattggtaagttaatccaaaaaatgtagctccacggaaaactgcctaaaataagtccacctaatccgggacctgccagtgcacctagagaaataaaaatactttcaacaccaaacgcacgtcctaactgtttggctggaaatgtatcggtgacaattgcatagctattagccatggtcatactggcaccaattccttgaacaaaacggcctcccaatacaaactcgattgtgtgtccagctccggctaaaaatgaaccgaccaagaaaataaatgtgccaatttcaaaaatttgcactcgtccgtattgatcaccaaattggccaaataataataacgtcgcacaaatggtaattaaatagaccgaaataattaaggttgtcgtaccagttgctgcatttaaactctgtgcaatttgaggaatcgcgatagccacaatgctcccatctacgatcaccatgaaaaagaataatcctagtaccgataatatcaaccagcgtcgtttttgtgatagcatttgaccaccctctcgatggtatcatggaccaatttatttgcttaagcaaataaaaaggcttggttttgtcaaactctttcaaaaaaattatattgtgacatcctacaaataacctgccaacactattctggaaaattcgaagtacaaagttaggactgttagatttaaaagttaatagaatttcttaacttttctaagttaaggggtattttaattacagaggcaatcttcattaatttaaattagtaatcaaatttttttaattcaaataacgatgtgctacatttggagtacaaaaggaagtgatacaaatgcccgctactgatcgtatacaagtacgtattgacgctgctataaagaaacgtgccgaagaaaaactaagagaaaagggctttacaatttctgaattcacaaggatgatcctggcagatgttgccaataacaaactgaccgtgagaattgaaactgcaaacaatcaagtaaacgcaagccttgctgaagttgtaaaaagatactgacaactcaaaagaaatcaaatcgtattcagatatagactctttggaaagggaattatttaagtaaatgcaaaaattcactttaactcctaccaaacaatttaaaaaaagcctaaaacgggtaaaaaagaacccacgctggaaaccaatctgtcaaaaatcatcaaattacaccgaaaccaatccgttaccatggcgatacgttcttcaatgctttatagaagactctgaaattccggattactttacgcacatccactaatggtcaaacaaaaatacccagaacgcaagtagcagtctgagtataatttgaaaagcacattgccataatacgtctctgtaagcttttaacttaaaaatgatttggttagtataaaaagtatttgtaacgagcgtccccacccctataaaacagccatagcctcctaaagtttagggatcctattctttttcctttgccaccacatttatattattactgactacaaatgagcttggcgtttcattcgctaacaccatactggacaattttggatacgaaacgggggcaggtagataatagaaagttggcatttttttgtaatagtgccatttttttagatctttttgattgtacaaccgtaatggcaataaaatcaggtacttttgtccatcctgagttgtcatgaaataatactgatcactttgatatccctcagaattgggaattgccccttgataataaccgactgaaatcgttgatgtgtaatcataatcgtattcaagtgattcatcatcacttaaagtggatttggtaattttagcaactgataaattcagaaattcagcccgctgtttaataaacgcacgccactggttatcagtatacttaggtttgtaagttgcttttaaaaaccgctttttgaacgttcggtttgaaatcctttgactatgagatcgagctttgtcggccttttcctgtttttggtaaagactctttgcatgctttttaagataaacctgtaattgcttggcatctttaacgctcaaaacatgtttgaaaatccaatgaaccgctgaatcatactgctgttgttcgcgtttgagtgatgccttggattccaagggcttactccctacctcataactagtatgagcagcacccaaagaatttgttccggcattaatcaaataagtgctagagaattcagcacgaggttgtttactaaaatcatcatcgttatttgagtaactcaacctaattttatgtttactaaaatcaccgccgaatcgcaccacaaagaggtcatcactatcctgactcataaaatctaggaaccctcgaccccttatcatcttcaatatatgtcaaattaaatatcattgccgacctatttttcgtctttggcaccttaattggttttttaaacgtgatatcgtattggtcatcggttccctgatccttcgctactgttgcaatcggatacttattaagaaatttcttagcgccatcagttgacccgctgaaatcaatagcaagaaatccaactatcaacgcacaaactacgaccgcaactgaaatcacaagcgtctttcttttcatcttttcccctatcgtctttcaaattcgtttttaagtcataaattatggtcaaacgttctaatcttagtattacttttccgccaacttacgtgacctggtcaatttaataatcgacacgatcggaacaactacgaaaggaagcactattgccacgccaaccatcgccgaaattgataagtacatcacaataaagaagaaactgttataaacaccataaagaataacaaggagaaataaataaccaatttcgccaagccaaattttaaatctggttcgtttaggtgcattcttagtaaacaacggcaatgcaaataccaccatcgcaccgatcaattgtagaaacaatgcgatcaacccagcattataaggccactgaagcatcgttgttgaagtcccaatcatttcaccttttgtctgcagctcatcttcaacaaaccagactgtctcgccaacaattagtaaggcatatggcaaaatgcaattgatccacaatcggtagtttctggtgaaccaacggctatctaattgataattttccggtttataatgataagccagccaaccaaatacaagtccaagaagcagtgcacctaccaaatccaaactcataaagctggttagcagtaaagcagaaagtccgctcgacgccacgccaaaaacgagcatcagacgcataccaacaagataaatggtcacaatcaagctcaccatcgccaagataaaatatagacgggcttttttcatcttctcatcctctattttcaattttttatattaggtcgtaaatttgacccttcggctagcttatttaaacaaaacaaatgacgtcttgttgttatgaagcttcgcaaaacgtcatctcaaaactacttagtttaaataaaataatcaatcaattgaaacaatcctaatcccacaaaaaagattccgtagatataggtccaaattcggtttggaataaagaacagtgctgatcggtctttaacttcaacttgttgcaaagtttgctcatcaacaaagactcttttttctttagaaataaaatacttgcagaataaatagttaattcctgctgataccagtccaaacacaatcagtgtaatccccgtctgtaataaagttgccatattcgtgctttctaatgcacctgaaattagaccaacacctaagccgccgagcattccagaaactagtactaaaagcccttttcctcgccacacaagcatattaattcctcctaatatttcaattatgaatatgatattacagtatttactgcttattgacaatagtaatttaagcaaatttgcaagttactattagataaaaagatttatcgagatcagttaaaaatttgaatactagtttttcacaaatccacctcgcaaagtacgcttccacattggggtagaacattgaactagtttttgtaaaaaaatacccagccacatacagcggcctgggtataagttgaaaacctattgtaatattaatacctttttaaaaattgaactagcaaaccaacaattatggctagcattacggcgcaaaatgctaaaagaaccacaaaaataatcgaaccctacattaacccaacctcatttcaaagattagctaaatttccgatgcattcctacattcactgccaatgacccagcaagaaacagaatcacggcaacgttagaaatcactgcaaacacagtggctgcattcaaaaatccaaaggcaatcaagacaaaaagccaagattgaattgctagccaaatgactacaccatctactaaagagagtttaaataatttgatatttaaaatatccaaaaacgctggcaaccgaaattcaaaatcactaactacttttctacacagatggtagctcactaagccaagtaaaacctgtgctagaaagaaaacaactaaaatggcaaccaaagaattaacttgatctccagtagctactgtaatggcatatactgggtgaccccagaaattaatcagtgtcggaatttgcgccagaatatactttccaaaatagacaactgtcaaaacctcaacaaaaatattcactaacataaatgcactaagtttgtatctgaactttatcatagtaagcctccatccccgcttgtgatctcataacttcaaattaaaatgtaagcgctttatttacaacttcattatactagcaatttatgaattagcaaacttctaatttttagtgctacaaaattttttcaatcaaacagtgcatactgttttctaaaaaatccaaaacaatagacctcaagttttttacaacctgaggtctattgttttatttcgtgtcagatccatacacaatggtttggaccttcttcgttattttggctatcttagggaatccactaaacccgctttggctatgaccatgtgtcatgacaactaaaatgtagcgttcgccatttggcaaagtcacaattccagcatcattattcgtgtcattcaagaagcccactttatcggccacattcgtcccactttctgcagctttagcgccagctggaattccagttcgataaatttgtttacgcattaaagccaaaattttcttctgatcactactattcttaaatgggcctttcgcttggctcagcttttccaataagagcattaggctgtggctggtcgttgtcgcaacttttgtttcttgaaaaacgggattgtaccagccctgtttcttaacaaaactattgaccgttgccatgccataactttgtaattcattatccgcgtaagtgttgtcactattcacgatcatttgataaaaaccattagtattggtggctgtccagctaaactgccctttttgcttttgattcatcaaaaaagcactgatgaataatttaaacgtgctggccgcgacttccggtgtatgtgcattggatgattcggttgttaagctacctttttcgtaaaccgccgcgttctttatcttcttagtagcctttttagaagcccccagattataaaaactaacgcttgtggttccgtcttttgtcactttattcagataagtttgcagctgagacttaattttttggcgttgttttaccacttgtgaacttcgcgaagcgttatccgcctgcgaagcactgctagccgcgttggaatttgattgtgcactacctgagtttattttgatgtaaattaatataatcaagagtactcccattacccatgggaaagctttgaaaataattctattaatactaggtttattatttcgattcattaatttcaatccttcagtgacgacaacccaatttttccccaataacaaagttgtgcctctttgatactctctttcaagaatactacttaacttgcatgttttgaacagtcttttagaagcttaatattaacgtttcattacattccaaaaaagtctagatactcagtaaaacacacccaatttaactcgcgcttcacgactcattttgtcaatcgtccaaacgggttcccagaccaaattgatttttacctgcttaacttcatcggccgccatcagtgcatcagaaatggcattatttaacagatcggtcagcggacatcccatcgtggtcagtgtcattgtcactgtgcataagcccgtttcatcaacttcaacgtcataaattaatcccaaacctaccagatcaacaccaagctctggatcaataacagttgataaaattcgaaaaccttgatctttaaaattttctttttctaaggtcattcaaggtaccccctaaccaattgcaccttccatttcaaaactaatcaaccggtttaattccaccgcatactccattggcaattttttcgtgaaaggttccacaaatcccatgacaatcatttcagtagcttttcgttcggaaattccccggctcatcaaataatagagttgctcttccgaaatttttgataccttcgcttcgtgctccattgaaacattactattcaaaatttcattgtatggaatcgtatcactagaagaatcatcatccataataatggtgtcacactctacatgagcaaacgagccggccgactgacgcgcaaacttaacatttccgcgataatcaacaattccgccgtctttagcaattgattttgacacgatggaagatgacgtctcaggcgcgttgtgaatcatttgggcacccgtatcttgatccacattatgaccggcaactgcaatcgacaacatggttccccgtgcgcctcttccgtttaaataaacggaaggatatttcatggttgttttggaaccgagattaccatctacccattccatcgtggcattttcaagtgcctgcgctcgtttagtttccaaactatacacattgtttgaccagttttgaatggtggtatatcggcaataagcgtctttcaacacattcacttcaacgaccgcggcatgtaaactatctgtatcatatttaggggctgtgcaaccttccacatagtcaattcgacccccctcgtccacaataataagtgtccgctcaaactgaccagaattagcggcgttaatccgaaaataagcctgaacgggaatttgtgtttggacacctttaggaacgtaaagaaatgtgccaccggaccaaacagccgcattcaatgcagcaaacttattattcgtgggtggtacaagtttgccaaaccattttttgaatagttgcggatatttttgtaaagcggtgtccgtatctgtaaaaataatccctttcttcgcaaaagattcgcgcatattatgataaaccgcttcggactcatattgcgcggaagagccggctaaatattgtctttccgcttgcggaacgcctaaccgatcaaatgtctttttgatggttgctggcacatcatcccagtttcgaaacttcttatccgttgccttttggtagtacaacatatttttcaagtccagatcatccagtttgggaccaaactttggaatgggcatcttctgataaactttataagccgccaatcgatagtctaacatccattttggttcatgcttttcggccgaaatttgccgaataattttttcatttaagcctttaccagttgaaaaaacaggcttcacatcatcatgaaatccatattcgtaatcttctgttgccattgttaattacctccttccaaagcttcttgagctgcatgccaagctaaagtggcacatttgattcgcgcggggaactccgccacactacctaaaatttctgcatcgccaagccatgctttcgcttttgttgaaatttgcttgcccataaccaactgaaaaaaagcttcacaacctgcaactgcctcagttttagttaacccggcaagcgcatctgtcatcatgcttgctgatgcttgtgaaatggtacaaccatttcctgtaaaagacacctgctgcaccttgtcgtctttcattaagataaaggcacgaatatcgtcgccacaggacacattatgtaattccacactagtcgtcgcatccggtaacgccagtttgtggtggggatgacttgcatgatccatgacgaccgccatatatagctgatttaatttatttagactcacctgcaaaaaactccttcaccatttgaattgcctggacaaaacgatccagatcttcaactgagttataaaaactcaaacttgcccgaacggtggcttgtacccctaacgtcgccattaatggttgcgcacagtggtgacctgctcgaacctcaacgcctaacatgtccaatccagtggccacgtcatgaggatgaagctgacctaaattaaacgaaatgatccccgcatgttgactagcctcttttgacccgtatattgtgagcttgttaacagcagtcagtttcggaaataaataagcggttaattgctgttctctggcgttaatttcagccatgccaatttcagacagatagtcaattgcagcgcctaacccaataacaccaccaatatttggggttccggcctcaaacttccatggtgctgcttgccaagtggcattcgtgcggctaacactttcgatcatttcaccaccaaattgaacgggtggcatttctgccagcaattctggtttgccataacacacaccaatgcccgttgtcgctagcatcttatgaccagaaaaggtcaaaaaatcggcatctaaatcctgaacatcaactttttgatgggcaacagattgagcagcatccaccacaatatacgcttgatgttggtgggctaattttgcgatttctttaatggggttagtcaccccaagtacattgctggtttgcgtgattgccacaatcttcgttttatttgttaatttgtgtttcaaatcagccatgtctaaagtctgatccgcatttaactcgacatatctcaaagttgcgtgtttccgtttcgccaattgttgccatggaatcaaattactgtgatgttccataattgtaatcagaatttcgtcgccttgagttaccactaaattgccaaaactagtggcaatcaaatttaaactatcagtagtggaccgggtatacacaattgatttagcactcggtgcattaataaatgcagcaacttgattccgtacctgttcgtaggcagctgttgcctcgttagccagggtgtaaacgccacgatggacattggcattcgagtgttgataaaaatcaccaatccaattcaaaacttgattaggagtttgcgaagtcgctgcattatccagatagaccaagggctcatcattaattttgcgttttaaaatcggaaagtcatgagacaaatttttaaacttattaggcattgggcaactttctttctaaacttttttggaagctttgacgtatttgaggattggctatttcttttgccaattcaccaataaatccccggaccactaatcgcttggcagttggttttgataggccgcgactcattaaataatacaattgtttcttatccaaacggccaacgctagcagcatgacctgcttccacatcattttcatcaattaacaaaatgggattagcatccccactagccttgtctgataacattaagatgcgattttcttgttccgcaatcgtcccatgcgccccgtggataattttgccaattccattaaagactaatcgtgattcatccaaaatgactcctcgctgtcgaattttacccacagaatggggagcaaaattagtaactcgcgtattcataccctgtgtttgttttccagaagtgatggccgcattgttaattgtggcaactgcccgtctaccaaccaactcggcgttcatttccgcaatgacgttgccatcgctaaaggatccgatcgaccaattaagatgcgcattttcaccaacagaagcttgacgattcaaataaattggttgagcggcagtaaaatcatccaaattaattaaattcaagtgactattggcctctaaaacaatttctgaaattcgatggccggttttggcggttcctgccccattgctctgtatcccaatcgtcgcctgtgcgccttcacctagaataatcaggttatgacttatttcctgctcaaactttgtctttgagttttccggtaaaaggattggcttcgttaattttgtgtttgcaggaatataaagaaagctcccagcattcacaaaggccgtactaaaattaaccaatcgatctgttaaagtcgtcagtgctttttgaagataatacttttccactagcttttcatgcttcattaacgccgtagccaacgtgcataaaatataatcatttgtactacaatccatctcttgatcgatagacggtttaacttgagtcattagttcgcctagttgccaatcttcataatgaactttggcaaaccggggcaatttagtattccgataattctttaaagcagtttttcgaatatccgtaaaccaagcaggctcatttggaaataagcctaactctggtaactttttcattatgggttcactcatcttcgttagacctccgaatcaaccaaatcaacatgaattcctaactcatctcgtaaaccagaataaccttcatcctccaagcgatcggccaatgaagcatcccccgtttttacgatgcggccacccatcataacgtgcacttgatcaggtttaatatatttcaaaattcgtttgtaatgggtaatcatcaacgttccaaaatctggacccataacatgattcacccctttagaaacaacttgaagcgcatcaatatcaagcccggaatccaattcatctaaaatggcaaaagtcggtttaatcatcagtaattgcaaaatttcattgcgtttccgttcgccaccagaaaagccctcgtttaaataacgttctgccatgtcactcgtcatatttaaaatggctaacgcactatctaactgagttaaaaaatctttaattggaattggggcaccttctggtcggcgggcattaatggcagcacgtaagaattccatgttggtaatgccttttatttctgccggatattgcatagccaaaaataatcctgcacgtgcccgcacatctaccgcttgctttaacaagcttttaccgttcaataaaatgtcaccctgtgtcacgtggtagcggggattacccataatggtttccgacaaggtagattttcctgtgccatttggacccataattgcatgaacttcaccggtatgaatcgttaaattgacgccggttagaatttccttcattttttgagtatcctcatctttaactgccacatgtaagtctttaatttctaaagttttcattctctgtcctccattatcccgataccgccacgccaagtaatgtcccgataaaataggtcactaacgtggtaaacacacccactgaaatgtttcgaatcaccgccttataaatcggtgttccagctttttgataaccaataatcgcgttgatcgaaagagctgcaatcattgccaacgacgtattccaaactcgccattgactagttgaaagactgattgccaatagtgggattaaagccccacataaaaacgaaaagaaggaagccgtagcagcatgaattggatttaagacatcaatttctctaatctttgtttgataggtttctgaagttttgtaaaccgttctggcttgcccttgaatacttaaccggttcagctggacctctttttgggcgcttacggaaataaattcaccaccagccatcgaacaggccccagcaagcataccggagacgccgctgatgaaaagtgtataactgtttaaattggctgctgctcccaaaacaattccagaaacagaaataataccgtcattggctcctaagattcccgctcgaatcacatttaaactatcctaaaaatgaaatcttttagttgtaatcaatttatgaatttctaacatctaatttctccaatcttatgtcgtcctgttaaattcttaatttttttgacgaaaaatgcatgaatcgggagcatcaaaaattcatgcattcaaaacaaatttagttaccggactaatttatcccagattacaactttatgggtagccaacgattttggcacatcgataatacgctgattggcgctccctcgaaattgaagggttaaatctttttgttcttccagaaaacgcccgtcaaccaaaatatccaatagcgacaacatttccaatttgtcgtctgaatccttcagcaattcatcccaggtataaccagaccaagaccaaatatccttgctatgaccaaattcttgacgcacccgtttacaaattcttaggcaaacttgggtattcaaaaaaggttcaccacccaataaggtcaatccctgcacataatcttgactgagatcttcaataatctgatcttccaattcttgagtgtaaggtttgccatagtgaaaattttgtgccgccacattgtagcaaccagggcagtgaaatggacagccactcacatataagctacagcgaacaccttcgccatccacaaagttaaaagccttataatcggcaatatactggagactaagatctttagccaaccactctttcggagtcggattgtttggaccgtgcattttttgcggcattctttatcatctccatcgttagattttttcttcgtgaagcaatttctacgtgtcggccatggaccattggccgttgttgcggatttcccaaatatccacaggttcgtttgacgacatcgcaatattgcggatcgtggttgccacattgtggacactgaaagccacgagcagtcgctttaaattcacccttaaacccacatttatagcacttatcaatcgacgtgttggttcctagatagcccacatgatcataggcccaatcccaaactgcttcgagagctttcggattttgcgtcaaattcggatattcacagtaatggataaaaccacccgaagcgtatttaggaaagtcctgttcaaaggttaatttttcaaatggggtcggatgtttacggacgtcatagtgaaaactatttgtgtaatattctttatctgtcacattggccactttaccaaacttcgcaatgtcgtcacgacaaaaagtatccgtcaaggactcagctggcgtggagtataaactataatgataaccactggcctgagcccactcatcacatttctgtcgcatggctttcacaactttttctgcaaattcgtgcgcttgggcattgtgctcccagttttcaccataaaacacagtgcacacttcgtataacccgatgtatcctaacgaaacagtcgcccgttgattcttaaataagtcatctacattcccatcggccggtaatcgtttgccaaatgccccatacatatacagtaatggtgcattttttggctgtgcttctttcgtgcgttcaatacgataggctaaggcttggtgacacaaattcatccgttcatcaaaaatctcccagaataacttttgatcaccattagcagacaacgccaaccgaggtaggtttagcgtgacgacgcctagattcattcgacctgagtttacttctttgccgttttcatcatgccatccctgtaaaaatgaccgacaccccatcggtgttttgaaactgcccgttaattccttgatcttgtcgtacattaaaagatctggatacattcgcttcgttgaacattcaactgctagttgtttaatatcgtaattgggatcagttggccgtaaatttaagccacgtttcaacgtgaaaattaactttggaaaaatagccgttcgatgctctgttcccagacccttgatccgaatttccagaattgatttttgaatttctcgttcaatccaactagtgcccagaccaaagttaacggtggtaaacggtgtctgcccttgtgaagaatataaagtgttgatttcatattccagtgcctgcatggcatcgtaaatgtccttacgtgtttttgctttggcataagccgcttgtttatcagcagccacccactttttggcatcagttaagtgtttttgataattaatctccgcataaggagccaaaagctgatcaattcggttggcggaacagccaccatactgaagtgaagccacgttcgcaatgatttgtgccatctgggccgtagcggtttgaatggagcgtggcgaatctacttcggcattaccaattttgtagccattttttaacatgccatcaaaatcgatcaaacagcagttagtttcgggagtcacgggtgaatagtccaagtcatgccagtgaatatcaccccgcaaatgagctttagctactaattctggcaacattttaagtcccatcgcccgactggcagcgccagcctccaaatctcgttgcgtattaaagatggtgctatctttattggcattttcatggacaacttcggcatccagttcaaaaactttttcaattcttttttgcacattcgtggcatcggcaaatttttgctgatcagctaaataaaaatctcgatacttttgggctgcttcagcgaatccctgattttttaattgggtcagaacagcatcatgaatatcacgcgtttgaataactgtttgatcatgaaattgatcatacaaagcctcataaattaattctctgtcactttcatctggtaaaaccttggataagctaaaaattaacttataaggatgaaacttggccgtttcgccatctcttttttgaattggaattgttcgtaatagtcctaatttgtctttaattgttgatatcatattgtacctcctactgctttatatattatctattattgtgttttagtaagtaaaataccacaacttgttgtaattttatcttatgtgcatactatatatagtagtccttttgagttcgtttgtgtatcacttttttagtcgattttctaaccaaatatccacaatgccgtttcgccgcagattagcgacccaaactttttttatttatttgaaagccttcccactttgggtacaaaaaaaggattatgacaaaaactaaatttttgtcatgatccttttgcttaaatttttattatgtcgatcaaactttattgaagtgctgtaactacttcaagtgttgctgagaaataattctttttttcaatcttctttggcaattgtttagccgtcttcttttgcaaactagtgtatttcattgtttttgctgcaaagttaaccggagcagtaaaggccgtattggtgtaactatgaacagctcttccagtcaaagtgtaaacagctgtaatcttcttacgtttgttaaagaaattcaattgtttctttaacgcgttttttgtcacgctatctttgctgattttataagtttgtgctaaccgccatggcactcggcaagcattataaccatactcatcatcttgtgcactctcgatttgataagccttgaatgccgaaagtttgatgctcttgccagttaccttgatgaaatcagggaacaagccagacttgtgacgcgcacttaacttcttaactgctacctggctttgtttggctacttttgtccaggtgctatctttggtgtaacttgcaaatgtcttgaagtatcccgtcatcaaatcagacgtccgaagtttactcttatcatagctgctggttgcccagttacccatttttggcaagtaagtggttgtattaatttctcgttttttgatagcctttaacaaagtcttggccgctgctttgtaatttgttttcttacttccccatttttatcagctaaaatgagtgaataagcaatatccaagtcaccatcggtcgcactatttttctctgaaccaacactcttcaattttcctgaacgactcgcttgtcgccacgtcataagagcatctttactggaaattcgatgggcacgataataagcgtacatttgattatatgtggtgtgcgtatttgcaccctttttagcagctaaaacagttgccaacatgccatatccttgaccttcggaagtgacgtaagttgcccctgatccattattgttcttcacatacttttgagattttccacctacataagctttcttccactgattatataaggtaaccgcttgactcgtttttgctcgtgcaggttgtgccttgagattggttaatcccacgaccacccctgcaacaatgacaagtcctaagaggctcacccataattttttctgcttcaaacttaagtcccccttccattagaataacctacttttattatagctataatcattgaaaggtgtaacaactagcttgaaatttttttaaatcaactaccctatcatccagccactaaaattcaatgctatttagtggcgcgttttaatagccaggtcaggccaattgccaaaattcccatcaaaacttctgcatatggtgtcattgccagaccagtagtttccacaatttgactgcctaacccggagccaatcataatcccaatgttaaacgccgaaatattcaaggcagatgctagtccaatatcttcgggatgatcctgttcagctaattgcacaataactaattgttcacccggcacattcatgaaggcaaataatcccaaaagaaggaccatcagtagtcccatccatttgaaactaataaacacacccaagaagagttgtgtgacagtcaacaaggtaaacatccacaaaagaccagttagtggcgtttgatttgcaaaccgcccacccactgtgttgccaatagccaccattaatccgtaaacaatcaaaataatcacaaccgtacttggctgaaaatgcatcaaacgggtcataattgggctgatataggtgtaactcgtaaaggtgctcccatatccaaaaatagttagtaatagtgctaacaatatttttttatcaaagataagtctgccaatatttttaatctgaatgggtctacccaccggtaaatttctaggaatcaatatccaagtcgctaataaactgaccaagccaattaaagctaaaaataaaaacgaaaaccgccaaccaaactgttgaccaacaaacgttcccagtggtactcctgtgacggtagcaaccgttaatcccgtgaacatcaaggcaatggcactcgctcgtttagaaggcgccaccacatctgcggcgatcacactagaaactgacatgaataagccatgaatgactgccgcaatcaagcgacctacaagaagccaggcaaagttttgtgcactagccgccattaaattgcccaatataaacacgaccatgataccgaccattagcgtatggcgattccatcgagctgttagaattgttagaactggtgctccaatcatgacaccaaaagcatatcccgaaacggttaagctcgccattgctaatgaaattttaaattggctcactagtaaaggtaataaacccacgctaatgaattcggttgatccgatggcgaaggcactaatcgccaaagaccaaagaattagcgttgcgtgttgtgtttgtttttctgtcatttgataacctccccaaaattatgtcgcaagattttattatagaggttataaaatggtccacaagtacgcactttacagtcagatagttacctaaaagtaagaattagagtaccttttgatagtatgggctttgggtatctaataaattaattttttggcccgcttttctttgccgttcaatatgtcgttcgccccagtggcacatttgatccgtcaaatcggccaatgtttgaccataatctgttaagcaatattcaacccggggtggaatttccggaaaaacttcgcgatggataatgtcatcatgctctaattcgcgtaactgctgggttaaaaccttttgggtaatgtttggaatcactctcaaaaattcaccattccgcatggattggcgttttaaatggcataaaataattgccttccacttaccattgatcacggacaatgtcgcttcgaccccaatgttgtacgttaaagttggttgtttcataattgcaaactcctttttaattcaaaaataaaaacaagtcaccaattatttcacgataacttgttcataagctttatgttgcccctgccaaggagttttattatagcatttcttcattcatttgacgcgttgcaaaccttctattttccgatataaccgatccacatcccaatcaacaaaatgactaaaacaaacgttgtaatccatacatacaaatgatcccgttctttcacaaatgcataaatagaaaccacaacccgtaaaacgggggttaggatcaatagaaatagccccaacattagaattgcaaacggctttagtgccacaattccactcaaaattgccttgaccgtggtgggataaaaattagccgcataaccagttttgccagtgaacacaactaagaggacaccgaccaaaataacggccgcagaaatgagtacgccaattcggagtactttgccgataattaactcaatctcgttcatttcttccattttttttaattcttcagctgtttctggttgtttattttgtgccattagattgtcaccccaaatcctttaagaaacatttgtagtccaatataaaagaggatgggaataaaaatcatccgtaaaacgtgggcccgtaaatgtttcataattctcgacccgatcagtgcaccgaccaaaatgccaatcgcaagaggcgccgcaatttctggtctgattgatccattaaagaaataaacagttgcactagccgctgcggtaactcccatcatcaggttactagtggcacttgaaggcttaagtggcatcttcatgatggtatccattgcaatgaccttgaaagccccactcccgattcccagtagtccactcgctaaccccgcacccagcatcatagtgaacccacctggaacatttgaaacctgatagtcgatttttttatcaatcgcattatcataatagctaccgtttaatttcaattttgttgacaaagaatcagcctgaatggcttccgttttttctttgccagccctcatttttcgatacatattccaagctgaaaacaaaagcaaaacaccaaataagacatacagaacggctgatggcaacacgccggttaaaactgcccctgcaatggcaccaattgtcgtcgcaatctctaaaaacatggccacacgtaaattaagcatgtcatcttttagatacgctaccgttgctccagaacttgttgcgatgacagaaatgatgcttgctccaattgcatatttaatatcaagccccatcaaaagtgtcaaaacaggtgtcacaatcatgccaccgccaattccaaaaattgcaccgaaaatgccagctcccagtccgacaataattaatagtaaaattgtatttatcatggatttttcctctccccttgagttctccatagcctgttactaaattccataataaaagaaattgcgcaggcaatcaataaaccctgaagattcagttaagatttactgccccttcaaggttagctgttcgtaatttaattagtgtaacatactatgaaaaacgacttaaaatccaaaataaaaatccaccgactgcaaaaattagccaccagtaacgcgccaaaaaaatcccaaccgttcaaatgatgtggtgttgtgtcaactttatacattgtttgctcagttccacgaattaactgatccaaactaatttcaaaaacattactcaaatcaattagattttcgacggtgggatatttttctccctgttcccactggtttacgattgtttcacttactcctaatcgttcgcccaaatctgcttgagagagcttcatttcacgtcgattatgataaatttcactttgcagctccatcgtcatcaccctttcaaattaattatgatgactataagatattaagtaaagaaaggtgattactaattctaataaaaaagctttacaaaaagaacgcgtgttcgtataatggtttttaaaaggagttgcttgtgttatgaaacagttatctggaaaaatttcatcgtcgattaaggttctcaatctaacgccccttgtgcgtttcgagttaactgatttacaaaatcaaaaaatcaattgtttagtccaccaacatgcactcaattttcctgccatggcgcaacccaactctcggattgcaatttatggacattacaataaacgccaccaatttgtcgtccaaaagtttatggttcaagcttcagaaaataatgattttttctcacattcagcttaactttaaaagtgaaccacactaggtgttggctgttgaataccactttctaggatttcaatatccaacaaagtttcttcatcactaaccagtttttctttaccattgataatactgtcatataaggaatcataaatccgtccataatcgccctgcaaagatgggatttgtttggaaatccaatcgccattttgattatgatatttaactttaccgtatttatcaggggtatctaagccaaaatttaagtctccgggcataattcctagtttaagatcattttcctgctgatcaatatcatactttacgtatgatccagctgttccatgtaaaataaatcgcggatttggcattgccactaacggatccgttttgactgtgacctttagcttgccataatgcaaatccatttgataataatcatcaagcgtactcttggtattctgaatcgtgcgaatatcgtaggcaactgactggggtttcccaaacaaggccagcatttggtccagcatatgaattcctagtccataaaatgtaccgttaattttatcaccagtgtgaacactattgtcaggtcgatatttgtccaagtgagattcaatctctaaaggttcacctacataccctctatccaaaacttcctttaaggtgagatagtcgctgtcaaagcgccgattttgataaggcattgcaattagatgtttttgttgggccaattttaagagctgttccgtttcattagctgttttgcagaatggcttttctaccaaaacatttttgccatggtttaacacctgtttagcaaaatcaaaatgtgtatcagctggtgtacaaatggtaatcaactgaatttcatcgtcatttaaaacttcatccaaatccgtggtgaaggtaatgcccattccttgataatttgcttctcgttcaggatgacggcaatgattataaatatactttacttcaatattttcacgctgtttcaggtaaggtagatggtaacgatttgcactttttccaaaaccaataattgccatttttaaagtcatttgagtgatcccctttttatttattaacttcatcataagcgaggtagaaatcgttttcaactgacttgattccatcttttctatttcacgtttgtagcgaaataaaaagcaactaaattagcgagttagttcgctagtttggttgccagttgccaaatcaacaatcacatttattttctaatcttaccaaacccataatacgacaaagctccaaatggcggtaaaacaaacaccaatgcgctccagattaatttattgccgcgtttgaattcatgactttttaaaatatcaacaagcgcaaacaactgaattaaaccacccaaaacaacaattggccaatactcttttttaaatgcatgatcgttcttcattagcttcacactcctcatttttattgttccaataaacacagtatgagctatcttgtaagcgttcgcaactattattcttatttaactaaaggttgaaagtatcaaaatcattatatcagtgtggtgatcgcaaagagtagacttagtctggaagcaaatgggctcagtagtgtcatttatcttagcgggtttcgcttagataaaggccgagattggagacctccaagtcgtgcccactattccgcctagtaatgatgattttcgttcgatattacgagcatgaatgaacggtgcgcggtttttttgaacaaattcgcggatgattgccggcacgtcattttgtggattctctcccaggctcccggtacaaatcgtgaaggcgttatagggtgattcgtacagctgctcaattttgagcatatcatcgcggtttttataaatccgtggtaagccaaacaatggaaatggcgggtcgtcgggatgcattgccattcggacgtcatacttttcacaagtgggcatgatggcatccagaaaatattttaaatttgaccgtaattggtcagcgtccacatcccgatatttggcaaataattgttggacatgggccaagcgttcaggctcccagcctggcatttcaaagcccttggagcccgacataatttggtgaatcagttcattcggatcatcaggtaacatttcaggctggtaagccatggcattcgagccatccggcaactgataggttagatcggtccgcagccagtcaaataccggcataaaattgtagcaaatcaccttcacgccggcttcagccaggttcttgatggtctgctgataattttcaatatattgatcccgtccaggctgaccggtcttgatatcatcatgaacattgaccgattcaatcacttcaaaacccaagccggcactggtgaccgcttgcttcagctgagcaattcgatcctttggccacacctcaccgacaggaacgtcataaagtgccgtgacggcctgagaaacccctggtatttggcgaatctccgccagttgaaccggatcattctgctcgccgaaccatctgaaccctattttcaagacaatcgtcctttccaaaccattaatgtgctactaatatatcacttttaaaattcccggtcaaagtcgctgccaccccatttcattcactttgacggttcaggaaaataattaatatggtaacatattctcagtggatcgattttaaaaaaagaaagatgagatgacatggaaagtttacaagacaaggcctataacgcaatctataccaaaatcatgaatctggatttgtaccccggtcaacaagtctccgacaaacaatttgaagaagaaattggggttagccggacccctgttagagaagccatgctccgtttgcggcgggacgacatgctttactcgcttccccaaagcggcacttacgtcactcgaattgacctgaaaaaatcactggatgcccgctatgcccgccagttgttggaatcagacatcgccaagtcaatcggtggcactgtttccgatgaccaaatcgatcagctgtcagctgtggtcgaagaacagcaaacggcctccaaacgtgatcagatccaacgattctttcaaatggacaaccattttcatcaaaagatttacgagtttgccaacaaacaaaatatttggaattggctaatcagtttcagtaccgacctgaatcgctatcggctgctcagagtttatgacgccaacctgcccatgaacagactgacccaagaacatcgagatattatcaatgccttcagtgaccatgatgcggcaaaggtacaccaactggtttatagccatctcaatttaatgctcagcgaacaacaatcagtgcttgataaatttccagactatttcaccaatattaattagaactcacagaattactccgatcaaacagttcttttacagttttgttaaaaagacaaagtgggcaaaggttgaatgttacactttttattgaatgaggaggagattatatatgaaaatgaatcaatttttgcgattggcactggttacctgtgcaaccacaatcacaattggaatgggactttgggggcagacgcgtacggtcaacgccagttcaagttcctataaaactgtctcaaccacagcgataaagaagacgccctatcacaaaagttcgaccaagggcgcggtgtataacgcttcacacaccaagaaggttgcaaatttaaagacctacccgtacaccacctggtacgcgacggccaaggtgactttgaagcatggcagttcaaaagcactctactataaagtgaaaaatggttccggaacagtttctggcattgtttggcataagtacttaaaggccggcacctcaccatttgggctcaaatatgccaagtctgcggtcgctttggatgtcaataccaataataacgtgtggacaaaaaacgccaacactgctcgacccatcgcttctctttccaaactgatgaccctctacctggttcgtcaaaagatttctcaaggcaaaggtacttggtccagtaaggtcaccacgagtaatgccggtttgaagaaattaggtaaatccaatgtcttcggcggctttaaattcaaccacaacagctacactgttcgtcagttgtacctggcaggtctgattgaatcatccaataacgccgcaattgcccttggacaatgggttgccggcggttcaacgcctgcttacaacaaaaaattcattggcatgatgaataatcaagccaaggaatggggattgaagcactcatcatttgtttcggcttccgggatggaacagaatagtttggctccttatggttacagtattggtgcttccaagaatgccaattacgtttcagccagcgatattgctcaaatttcccgtcacttcgttgttgattacaacgatattttgaccgacgcttcagttaaatcaatgaaggtcgatggtcaaacgcttcacaactacaataacctgctgccaggacgaaagtattatcaaaagtccctgaacgttgatggcttaaagaccggctacaccgatccggcgggttactgcttcgtcggaactggtcgtaagtcaggccatgaccggattatcacggttgtcctgcatgacgaaaacgagtttaccgaaacccggtccttgatgaattacgtttataaccagaatctggcttagtactgtgtggatgcagcatcttgagtaaaggatcagacaattatttccctctagaaatgattgcctgatcctttttgaattggtacaaaccctaattgacttattggcgaaaaaatcataatcttatagatagtgatttcattatacaaatagttgagtttcgggggagcgtctacataatcatggaaaatgaaagcaattatgacctatacacacggctcagtccgcgttgctggtctgaagcactggtcgccaaagcagctgaaaacgaattgaagtatcgcgccattcatggtgatggtgaggctcgaatgctgttagagctgcatcaactggaaccggccaaaaagcctttattcggccacgcagtccattccagagctgaaaagatgcgttcgtataaattcatctatacgttgcatttgaagtttggccattaaacaatctaaaaagccgttgagacaaaagttgatttcttttgtccaacggcttttttgaattcagttagatgttggcatcccaacaccaccgcattcagttacatcgctgtcattccaccatcaatcacgaattcagatcctgttgagtagctagcgtcatctgatgctaagaagagcaccatttttgatacttcttcaggttctgccactctttgcagcggaattgattttgcaaactgcttgatgacttcttcactatcaccttggtgaatcattggggtggaaattacccctgggtgaaccgagttaacccggatgtgagaaccggccaactgcaatgctgcagctttagtcatcccacgaacggcaaacttggtatcggtgtaaccaatcgcaccaccaaccagaccgttcattgatgaaatattaacgatactgccgctgccattcttcttcatggcttcagctgcgtatttcatccccaagaagacggaaagctggttgatcttaaagatcttcatgtagtcatcgagagtgatatcggaaagcggtttgttaaaactgattccggcattattaaccagaatatccagcttaccgaacttcttcaccgtttcatcaatgacgttcttccaatcatcttcactggaaacatcctgcttgataaaaataacgttatcgcctaattcatcagccagagcgttccctttttctgcgttaatatcggtaagcgcaactttagcgccttcgttaacgaacatcttggcgtgactggcacccattccttgagatgcaccagtaataattgcaactttgttatctaatttccccatatgtcatacctccttgtaagcgtttcctatctacaagtacagtataactgatttattttaatttcctaaatgttttgcttattaaaatttgaggagaatctttttcttcttggcattcttttccaacttcttgtgagcccacgcagcatcctcgtaggacttctccaaaaccgggtcctccagcagataaccgtcagccatcagccgattaataaacttagccgcatcttgaatttgatccagtggcgcgttgctgatcacaaacccgctgattgtctttgactgggtataaaactgacggacgtcaaacgagaattgattgctctttggtgctgtaatcaagcagactttgccgcccggcttcaatgcccgtaaattatcctggagttgaacttgcccagaggtatcgaccacatagtcaactttttgaatttcagccttggagagctgtttctttaatgacttatcgtaattcagacattgatcgcttcccaagcgatccagcaggtcaaagtcgctcgtgttggaagtcgtgaccaccttgagtcccataatgtgggccatctggacaaactttgttccaacgtggccggtggcgccttcaaccaggattgatgctccggagacggccccaaacactttggtcaacacgattgcggcagttgccgctgaatgaacggcggccaccaattgagtcggctccacgtgttcgggcacatggaatggtctggccgcgggaatggcagcgtactcgctggtcaccccttggcggccggcatagcccatgctgttggtccaaacccagttgcctttggaaaaaccggtgacgtcagctccgacttcttcaacttgaccaacggcatccctgccgatcacaaacggaaaattggtatcggttttaaaagatcccgaacggacaaacgtgtcgacatggttgacggccaccgcattcactttaattaacacttcatcattggtaatttcaggcttcggcaactcaccaatcttgatgtcctttgcctcaccattttgtgtaatatatgctgctcgcataataatgcctcccatccagatagctgattcttaacaccttgattataaggccaaaacgataagtgaacaggaataagaaccatgaaaaaatgggtgtaaaaaaagcctgagcattatcaagcgtgctcagaccctgaaagtgagaatggattcaattcagccggattttcagttaaaacggcgatcttgacaactcatcagcatttaagcaaataaagccattatttcaagccggaaataatcgatttatccccttaaatctgtcagccaagccgcctgctaactgaagaatcacttgctcaaccactgaatcttaaactgctgctcgccgtcaatcgaatgaacggtttcttcatccccattaaccggtgcatgcgggattctgaagctggggtgcatgtggctggtaaagtcaaactcataaccaatcccagacttttgcttttcagctttcatcaaaccaaacgtgccatcagacagtttaacgatctgttccttctttttggaagggtcaacataaattgttgtcataatctgcacctccacttacattatagcagtggtttttggtactgatgacattaatcaaaagttatcgctgaaacgcccttgacttagagtccacttcaaagtttatagtgaaaccaatcccatttaaatcctagtcaccaatttgttggaaacgagtatactgaaattaagaccttttcagaaaacaattaattaatcaaaataataaggagtcataatgaaacaatacacaaatcaatattttgacggtgaacgaccactgtttgccgaaaccaacgcggacatttccggcaccacatttggcaccggggaatcccctctcaaagaaagtcgcaacattcacttaatcgattcaatttttacctacaaatacccactgtggtacagcaaacacgtcaaggttgaccactcgatcttagaaaccatggcccgttcaggaatctggtacactcacgatattgaaatcaacgacagtgcgattcaagcgcccaaaattttcaggcgctgcagtgatatcacgctgaataacgaccacttttccgacgccaaagaaaccctctggaactgtcaaaacatcaagatcaacaacgtccaggccaacggagattattttggcatgaatagtgaaaacatttccgttgaccatctgaatctaattggcaactatgtctttgacggtgccaaaaatgtcgaggtccatcattcaactctcgtgtccaaagatgctttctggaactgcgaaaacgtcaagatcgtcgattccacaattaacggtgaatatctggcatggaatacgaagaacctcacgctgatcaactgtacgattgaaagcgatcaggggttatgctacattgatcacctcacgatgcgtaactgccgcttactgcggaccgatttggcatttgaatactgttctgacattgacgcagaaatcaactcaaacatcatgagtgtcaaaaatccaatcagcggcaccattcatgctcgttcaatcggtgaggttattattgaccctaccaaagtcgatccaagtaaaacgactatcattactgataacaaaacatctaaaaaggagacagcctaatgtatgactttacttcaatgatttcgcggcgaaataccgattcagttaaatgggatgtcaaacctaatgagctgccaatgtgggtcgccgacatggacttcaaggtcgctcccgagattctcgatgcaatgcgtcaaaaagttgactttggcatcttcggatacgaggaaccgcacaccgattattttgatgcagttgcccactggtaccaaacggaacatcatgcgacaatcaaccgggattggatgttcttttcgactggcgttgtgccgacgatatcctcagctgttcgccgcgtcaccaatgtgggcgataacgtcctggttcaagcgccggtttacaatattttctataattccatcgtgaacaatggtcgccatgtgttgtcatccgatctggtctatgatcaaaaagcccaccagtatcagattgattgggatgatttggacgccaaactggccgagccgctgaccaccatgatgatcttgtgcaacccacacaacccaattggaaaagtgtggaccaaagctgaacttattaaaattaaccagctctgtctcaaacacagcgtcaccctgctgtcagatgaaattcacggcgacttggtgtttaagggtgctgactacacgccagtgttctcattgccaaatgagctgctgcaaaacgtcatcgtctgcgtctcacccagcaaaacatttaatgttgccgccctgcacgccgcaacggtcatcgttccaaacgaagccctgcgcagcaaagtgaaccggggaattaacaccgatgaactcggcgaacccaacctcttggcgattccgggcaccattgccgcctacaccaaagcgggcgactgggtccatgaactgagaaaccaaattcgggcaaattacgaaatggtcgtcaaattctgccaggcaaacattcacgaaattgtcgtggttccgtcaactgccacctatttggtctggatcgacgtcagccaactgaccgacgactcggcaaaattagccgctttcattcgcgcccaaaccggcctgtatctttctgccggcgatgtgtatggcggtgatggcaaccacttcttgcgaatgaatattgccagtccgaaaaccatggttgaagatggcttgaaccggctgcaacaagggattaaagaatttaaagccaccaactaactacttaattgaataatcaaatcattcagccccaatcaaaaatcccgaagactttttgattggggctgaatgggttataaatgacagttatttaaattcaatgccatataaacaattatcgtatgtccactgcatgatggcctgtaaatcaccagtttcgtaataatcggccagtaatgtgttaaaggtttctaattggttttcattgatattaacaattccggcaccggcattaatcaaaatataattggcagacaaaatagcagtccgcttgttaccatcccagaagatctgctgccgcataatctcatacattatttgaagcgccttttcagtagcagtctgatcatcacccattattttttgaattacgcttttgacattattgacatctggaactggcggtacatactgaacaccgccgatctggacacttccagtccgaatttgtccggggacgagggcatcttcggccgcgacgattcgattaatttgccgacaaatatctaatcgaaatggttcactgtgacttaatacaaattccaacccttttttgagactaatgatgacctgaatatcatcaatcgaaacaccagcgacactcatgccgtcaataatcgtcttggtttgcggcagagtcgtattaactccctcaaattttgaattagaatacaccatattgacaagattctttttcgtaagaaagcgattttgtttgagagtaagattgaatttattttccataatcgcccctcttttctataccatcaatttgattatctcaaacattcttaagtctgtatacctttgcatcaattaccaaaaatgatggcaaatggcagacttgctgctggctggaggaagcaatcaaaaaagatctattcagtagtcgaatcatttcaactcctgaatagatctgaattaatttaggcttcaacaatcttgccaacagcaatcggcaacgtcgtatgctgatcatatttaccaacggcaccttggatggtatcaggtaaatccatcgactgaggaaccccgtgaatgtaaaccacccgcttctcaaggtggaggtcggcatcattaaagacttccttgaacttctcgctgatttcgcccaacggcactgtcttctcgtagtggaaatgaccgtcggcatcagaagttgggtaagtgtcagttgggatatccatcttctccggagcgtcgttaaacgggaccattgtcgttccggacactggttcggtttccggcaagtcaacgtagccgtcatggttggtgtcttgggcggcagttgccggttgagcatccctgccatctgggaaaccgtgaaaatgcatccagtgttgggtgtttggtgacgtatgatccatcgtgatttcaacagttagtgtatcgccatcaatcgtaaatgtggcctcaccagtaggatgagtaccaatcttgtcgccattcaatgaagtaatttctgctttgtatgtttttgtcatgagaaacgcttcccttgtataatttgttgatccaacctaactatacgcgctatatgagttgtgtacaatctatttatttaaattttccagaaaactaatggggttggttaaccggccactgcggctgctggccattcaagacccgaaccacttcacttgccgcatccgtggccattcttgaaaagctttcaaccgtactggaaccaatgtggggtgtcaataacacattatccagcttgaataacccactgttcattggtaagggctcttcgtcaaagacgtcaagagcagcaccactaatcgagccgcttttaagtgcatcaatcaacgcagcggtatcaaccagggcaccacgacccaggttgatcaaaacactggtcggcttcatctctgccaattgctttcgaccgataatgtgtcgggtctgagaattggcagctaaatggagggtcaaaatatccgcagattttactaaggtatcgagatcgacaaattccccgtatggtgattcccgtggggtccggttatgaatcataattcgcatccctagcgcactagcttttttggccaccagacggccaattttgccgtaaccaagaatccccaaagttttcccttcaagatcgaatcccaaatgagccaacgggtaggtaaagttgccatcccgcatttccatcgagtttttggtaatgtgcttagacacgtccatgatctctgccaaagtcgtttcagccacagttgccgcattggcattgggcgtattggtcacccaaacaccgtgattggcgctggcgtccaagtccacactgtcatagccgacgccgtgtcgggcaataatcttcaaattgggcatgtgagaaatcacattctcgccgactggatccaaaaataaaatcattgcggcagcatccttgccattcttcaaaatattttcagcgttagcccgcatcaattccacgacttccaggccgtgctcacgtaaataacgttttccgtccggatgcaattgagccggaacgagtactttatcagccatcatcaagtcccccctatacattttctttggcaaatgccagcatcttttccgtctgctgattcagcagtggcggtaggtcatcaaaatcgaaatagtccagtcgaatggtctcgtcagtctcagcggacagcaattggccgccaactttcctgactaaaaacagccgatcaattgtctgcacctgatcaccatttggataggcgaagattccctgatcgaataatccgagcggccggacaatctcaacttttacgccgctatcttcttgatactcacgcacacaagtctgggcatatgtttcaccgaactccatgtagccacccggcaaactccagttatgactatcggttcttaaatttaagagtacttggtgctgatcatttaataggattccagcggccgtattcaaaattaaaggcatgtggcccacgcgttttcgaatccgaccaatatagcctgttgccatttcatcaccactttctcgaaaaaatctgaatctctgctgttatgttcttacaaaacggctcacaaagcaagctaatcgcgtgttgatctatgaagctcccagcaggatactaacatatcagtagtgttttctgatgattcagctcattctgacgaaaataacgcttccaatcaacaaattaaaacaaatccataactgtcaacgttttcattgatgtttccacttgtattaatttgagaagtgtttagaataacaattgaagcaagagagaaatatcagctctaatatgttagttatccacctcttaccccattttgaaactgattgagacacgaaaggaagtttgactatgacaaacacagattggaaagcatcattaaaatcaccaaaggcattcaacgactttatcatcaactattttaaggaccacaaggaactgaccggtaattacgaaactccttcatactacgagtactatactgtcactttgaacagcgaaaagggcctagtgatcaccttggtcagctcgattaatccaacggttaacgccgatgcgccgacaattcctttcaaagatgttgaaaccatctcggttgaagaattccgtcagcttatcctcaacaagaaattcgccgacatgcatacctcattggctgacgtctttcagacggttgccggggtgccaggatccacaaaataagctgggcaaatcaaattcccagctaatgccgattgcttttgaacggcacaatacgctaagaggccggacaaattgatgtccgacctcttttttcgtgctaatttccacaacgatcaacgaataatttttttattaggatctaaaatattgattaccaagacaactaccaacatcgcgaccaccccgacaaacaccatatgaagggctgtcaggatgattggatcaatcagcgaccgattggccaccacggcggcccctttggaactgatgacgttattgacctttgaaaaggtgattccgccgtgcagctgcaatcgaatcactaaattcaagattgcaccatacaccccggccatcaccgtttggcccaaggaacgaccaagggtgaggactgaagtcgccgaaccgaccatttcattgggaaccaaatgctggctaagaatcgtattcatgctgacaacgatccccattccaatcccattaatcatggcaatcacataaaatgcccagaccggaaatgcttgactggcaaagatcagtgacaaataactgagcagcatcacaccaatcaaggtcactgcaatttgtttgggaacaaagtgagcaatcaatttaccgacaaaaaacgaggcgaccagccacatgattgagctggaggtcacgactaacccggcagtggttgcggatacccgatacaatgattgcagccaaattgggaaatacatttgataaccaattaagaccccactcaaaattgttgctgtgataatttgaatggtaaaggttttggaatgaaacatttttggtgaaattaacgggtctgcgaaatgcttttcatggcgaagaaataaccaagttgccacaatcgtcactatcaacaggctggctgcaatcagcggcagcgtgtccaatgcctgaatccccagcaataagctgaccagtgaaattgccagccagataatccccagccaatcaatgatcagctgattcttgagctcaatattttcctgataccccagccagatcagcagggcgacgatgatgcccaagggcacgttgacgaagaatacccagtgccaggaaagatggtccactaaaaaaccgccaatcagcgggccgaccaaggctgacagtccccaggcggtattattgagtgccagcacatttgcccgctgttcaaacgaaaaaatatcggcgatgatcgtaaacgtcagtggcatgaccgcaccggccccaattccctgaattgcccgggcgacgatcaagaataaaatcgaaggtgacaatccgcttaaaagcgagccgatggtgaagacggtcacaccccactgaaatacttttcgtcggcccaacgtatcggccaacttgccgtagattggtgtcgtgatcgcagtcgtcaacagataggcactcataatccagctttgataagccagcccatgaagttcgctaataattgagggcagtgccgtcgtcacgatggtcacttcaacggaagtcataaacgtcgcgataaagaccgcgatcaggatcaccccgcgattacgatgtccaatatttgaatgattcattttgtgaagacccctatcgtgttatgataatcattattaataaaatggtacgcaattaatgataccacaagctaatggaggtccgaattgaaattacattatcaaccggcaaggatggatgagttgaccgcaattatggtgatcgaagaagcaggcttttcgccggccgaggcagccaccaaaactgcgatggcggaaagaatccggttgtatccggacacatttattgtcgccacaaatgaggccaatcaagtggtcggttacatcgtcggtccggcattttcacaacggtatctgacagatgaactatttgaacaggcccacgccaaccgtcgagatgatccttatcaaacggtcctcagcttggcggtccatcccgattttcgcggccatggcattgccagccgcctgctgagcgaattggctcaggttgccaaagcacaaagcagagtggctatcaccctgacctgtctggcagacctgatcccattttatgaaagcaatggctatcaaaacgaaggcatttcagcatccagtcatgccggggaaacttggtacaatttagtctatcccctgcaataattcataagccttcattaagaccgcttggtttgaagcaagatttcttgaacgatcttgattggaatgctattattcaggcaaaatgattttatgtaacttcaagagagggttccttatgaaaaaaagaagtttcattctcgccgcagtcgccagtgccacctttgctttagcggtgccattgacgttgaacatgcctcaaagtccgattacttatgccaaatcaactcagcggattgccggcaaaacggttgccaaggccatcaaaagcacccctgatttgaatccaacatcaagtgtccgcaaataccccgcttatatctatgacaaatattggcaggtctttgaccgctggtacaatgtccaaccaatgagtgcccagggcatcttcaaaaatcatacggcaaaggtctacgtagccaatcaatcattgaagtcttatacctacgccgcgatgcagaattggaacaaggccctcaaaaccaaagcgtttaaattaggcaccaaagctgaccacacgattacagtgggctttaaaaatgctgggaccgggcaaggcagctgggatggctattacattaccagcaagctttacatcaactataatttcttcgacaacaccaagtacctgccggctgtctacaaagctgagaccggtcatgcactgccatcagctgatcagccaaacagtgcagattaccaggcactctatgacacctactggaaatcagtgattacccatgaactgggccacagccttggcttggatcacaccccgtactccaatgatattatggaagctgattcgggaactaagagcggtgacgcgaagtactcctggagccaatccaaagtagtcaacgatgattacgcgattttccaggataaattatcttccagagatattaatcgtgccaagttaaccaaggttttgggttactggtaaagatcaaaacagcttaaaaatttcctcaacaaaatgcggctgggcaaaaggtgatccttttgttcagccgcattttattatgttagagcttaaacgtgtgaaagaggacaacaattggattttaagcccctccacccgaaaacctgactcggtttcgttgtgtctcacttttatcttgattaaacgtgtgaaagaggacagcgattggattttaagcccctccacccgaaaacctgactcggtttcgttgcgtctcacttttattttgattaaacgtgtaaaagaggacagcaatcggattttaagcccctccagccgaaaacctgactcggtttccgtctggaggggcttaaaatccaattgctagacgtcctctttcacactctgccgataactactatcaaacgaaatcagaaaaatcacggtcacgaccagaattgttccccaaactgccaggaaaaccggccacgacgccagtgcactaaccgtatgagtcaccgaaattcccggctgccaatcgattaacgcatgaatcagaaccacccaggttaaggtattggtcgtcaacctgattgatgcaaaaatcgccccaatcacaaaagcgtaggtcgcctgttgaagggttggtaaaaagccctgccctgagatcagattcatgaaatgaaagaggccgaagaagattccggaagccaacgcggcctcggtaaacttatatttggcctgtttgaagacgctcaggaatgccgagaacaacaatccccgacacaggaattcttcaaagattcccgctgacaatgccatcatggtatcggcaaccaccgttttggcatgcatcatcaaagccgtgtgaccgagaatgctaatcaataggaataatccacccaggcaaatgccaaaaatgaatccccagattttggcaaaagtccccaacttgactttagtctgaaaaattttcatcgttcccagtacatagaaaacaattccggcaacgaccagcgcaaacatcagtcgggcaccgccgcgaaccagtggccctgctccccggaccgaaaagtcgacacccatcaagaggaccagaaaaagggctgccaaccagaattcctttccccaagacattttattcttaatcatccattgtgaccccgtttcattatgtaaaaaagcggccgaacaaaagcaaaactttcgtttcggccacttttgcgtacactgattatttcgcgatgacgtcagttaccagctgagcctagtcatccaggtaaacagctgtcaccgcgctcctattaagtgtaccgcattataaggtttgagcaaagaacccaaccacgtcatcccagacatcatccaggtatcccttagcgtgacgactaccggttaacatccgggttcgataaggaatttggtgtttggtcaaagcttgagccatgtccaggactccactggttggcacaaattcattcagtgaattggccaaatacatctgaccagtctggtcggttactcgatgaaccggagtggcttcggtgtattggtcggtccggccgttaaagtagttggtcacaaaccacttataaaacggatcgttggccccagtctggttaatattcgagctggcggttgaattaaagccactcgtgtcaccttctgcggcaaccacatcttcatgctcgctcaaccacttatcaatatccaaaatgccagacagtgaggcaatcggaatgccatatttgattgccaattcgacggtcatgttgccaccggcggacgagccaaatgccccgatatggtcgtggttgaacggcaagtcggatttcttcaaccattcatacaagtgatccatatcttccaaaggtgccggatagaaagccgctggcgtaattcgataagccggcgttacaaccaggtagccggcttccacaaaccggatcgaggaatcctcatctttggacttgttgccgcggaaccaaccgccaccatggatatcaatgattgcgcctttgctttgcgccttttcgccatcataataaatgtcagttaactggtggtgaacagcatcatattcaacgtcttttttaatcactaaatttgtcatgtgaatcctccccaaatagataacttgttatttcaacaaaagtatctacccgaagcaggttgtggtcaatcaaatcgacttgaggagatttaatcccaaaaccggctaaccccgtgatttattttgcggttggtcatctttcttccaaacctcaattgaatcatatttaacgccggtcaaatcctcacaaactgccttggggtgtggatccacatcactcatactaccgcccttttgcagacgaacaagttctgcagaaagaaccatgaatgtcttcttgctgagatgaaagcggccgacaaacagcattgccaagacgatcatcaagccaacgccacccgatacgataaagataatcatattaatggcactctgcggctgaacaactgccccgcttgccgactcccgaaaatgggcaaagtccagcaaatatccggcaaccacaccggcaacaccgacactgatttgattaacaaaggtcatcacggaggcaaacaggccggcccggttccttcctgtcaccaatgtatccagatcgggaataaacggaaacgcgttccatggggcaaagtacaaaatgtacaaccccacttcccaaaaaatcataaaaataaccaaccaaatcattttcatttaactatttttcgataaccatggccttctttgcggtgacatagtggccattggttagttgcacatttcgttcaatatttaccattaaaactcatcgaagtcggcaccaaccgtgtgatcattaaatgaaatcgtcagcttattgccatccaacttcacttctggaatcacaatcttgccatcatcatccaggctctcgagctcacgatcaccaagatacagtgagatcaaggtgtacttgcctggggccaaaacaccagtttgcaggggaatcttggtcttattgaagtagagattggtgttgggttccggcgttgacaattcagttgtcaattcctttgacaagccgactaatccggtaatgccgactcttgaatgatagaaaacggcattagctgctctggtcttcatttcatattcatcaggtgctccactgtcaggagctgagaaactgccttcagccaaatgaagctcccggccggtattgacttcatgaacccgcacatgccatggcattgccggcacaacaaagttcttgatttcaacatcatcgtacggcttccagtctgagtagacgtagttgtcgtggattgcgtaatcatcgtacttgaaggcggtttgccagaagttttccgattcggcaactgccaaggtattatcataagccccctgtttcaaaagaacggatcctttaggcgtactgaaaccaaaggtggttgagtagacatacttctcatacttggcttcaccatgggcatgctcgtgggagtgctgaccggcagtaaatgactgaacttccaaaccattttgactgtgggcaatcagcattctaggttccggctgcttcttcaaagcttcaaacttgaagtcatcactttctttggtggtccagaacggatcatcatcaggtaaggcaaagaagataaaggtcttcaaggcccagtaagcagaagccggcccgttgtaaccttcagcaaaattcatattgggataagcatagccgattggaatcaacccatccgtctggaagatgttctgctggaaccaccaacgcaggttgttcaacagcaagtgcttgatatcacctaagctatacccttcaggcatatcaacatgcgcataggcataagccgcccaaaaggctgcctgggcaaatcggtaatccaaactgcgtccgtatggcaaggcagcaccatcagcggcaaaccagttggcataacttgggacaaatttctgggcgcgttctttcaataattgactttgcttgttatcagtgtgtgccaagccaaccgttaggatcgtaaagaactggtaggcaaacggaatgtagttatcgatctggttgacataaccatcgtaggaccagccatgacccaggtaatgtttattggtgatcgcataatcagcatcgatcaactctgaattatccatgtagccggaatcagtgataaattggttgaccatcgcacggaagaataaccagttggtctttggaatcaccttgtggttcacctgatccatccatttgacaatcgttttttgctttttaacggtcaaattatcccagaaataatcttttgtttcatacaagaaggcagtcaaagcgcccatctctacgaagacctggtcatagtcaccaagatctccaccccagtaatcaggatcatcaggatcagttccggctaagatgccttgcgtcaccaactcgtaccagtctggacgttcgtatacccgctttttatcactaaagaatggccctaagccccaaagcaggcgcatgaaaccttccacttcggtcttgtcttggaggtaaacggccccactgtcactcatccggaagcggccctttcgtttttgttgcgccaaaacttccatggcaggcgctaaaatgtcgaccagggcagctttgacatccgctttactgcggagtgggttgtctttaatttgttcattaaataattttcgtttcactgttaaaatcacctcatcattgtattttgaaagcgcttttacagtgttaatcatactgcatattttactaaaacacaagtaaatttggcacttcttttcctaattcaattgtgctttatggtaaataaaaagcagccaatcgtggctgcttcaaacaattaagctttcgtaatcttaaaaccaaaatcaatatcttttcctgcgggaatgtgatactgctcttcaacatcccgaccccagctgtcaatgccgccaacaccacgaactgcgcccaagattgaaacgaccgtccgtcttggcaatggcaattcttcttgatgagtggcgttttccagttcttcagccgtatatggtaggcagctaaaggcaaacggctggccgtcactttcaaatttaatgctaaacggtgtgtccgagtgatccgagctgactttggtagcgttgcgggtcactgtgacccaatcggtcttcatgtgcaccccacagtcttggggaaccatgtagttggttactggcaagccgtcaattcgatactcgccgggaatcccgccagccatgcgatccggataggtttcaccggacaagccagcatattcgtagccggttgcggcagtcggcaaaataaagcgcatcccaaagactggcaaatccggcaattgatcattaccggcataatgggcatggatgctgatcacaccatcacctgtcaccgtatagtgaacctcgacatccgtacttggaattgtcagggttgcaaaatgataaatcacttctactttgtcggcatactcatggttggaatactgattattccgcggtgcactgggaaattcaatcaactggtcgttaattttaatatcgactttatcggcactggcaaacatatcggcgccataccattgaacagcttgtttcgagaaaccattaccacggtcattatcggtggttgcccgccagaaggttggcttaggctcacgatacatccactcacgaccatcgacgaccattgattccatgccgccgcgggtgtaattgaagatgtaatggaaattgtcaccgccaacgccgaggccaccatcgccatataccaagtgcaattgtttatttgtgttgtccataatagtatttcacctcctgcattgccggcttctcggtccgatcagcaaacattaatccatcaccggaaaattcgtagtcagacatccggtcatcgaaatcgccgccatatctgagaactttttggccggtgatttcgtcattgacttcaattgcctgatcgataaagtcccaaataaacccaccagcgtacattggatacttgtcaatcagatcaatgtaggatttcatcccgccaagtgagttacccatgtcatgcatgtattcgcacaagaggaatggtttcttcggattatgatccaggtaatcctggatttcgtctggggaagcatacatccgactttcaacgtctgagatcacatcttcatacttgcggttttgaacaaccccttcatagtgaaccagtctggttgggtcagcctgcttgtagaattgttccatggccgcaatgtcatcgccggcatatgattcattacctaatgaccagaagagaatgctggcatgattcttcagcatttcatagttgttgcgggcgcggtcgatcacggcagctttccactgaggaaccgatccaggcacgttgtaagatggttccactgcacctagtttttgccaagtaccgtgagattccaaattattctcggccatgacataaatcccgttgatgtcacacaggtgataccacagcgtgtgatcaggataatgacaggtccgcaccgcgttaatgttattctgcttgaaagttcgaatgtcggctttcatatcgtcaacggaaaccacccggccggaatgacaatcccactcgtggcggttgacgccgttgatgactaaacgcttcccgttaagggtaatgaccttgtcttgattaatttcaatctttctaaagccaaatttgtaaggcacgatttctaagacgttaccatcttgatcatcaatttcaatcgtcagctgatacaaataaggatcatggttatcatacaaatgaacgtttttaaatgaaacgttactcaaagtgatggcgtcatccaccgactgggaatccgcgtacagtccattgccgtctgcatcggtaaccgacactttggcggtggcacccgatttgttaactgtcatttttgtggtgacattcaaagtgccatctttcaaatcatcgctcaaggttggtttaatggacaggtcttcaatgtgagcttctggttgggcaatcaaggaaacatccctaaaaatcccaaagaaacggaacatgtcctgatcttccagccatgccgccgtgctgagtttgaagacttccacggccaacgtattctcaccatcttgaagatatggggttaaatcgaattctgacggggtaaaactgtcctcggcatatcctaagaaatgaccgttgagccaaacatacatcgccttttcaacgccatcgaaacggacgcgaacctttttatctttgaatgctgagttcaaagtgaattttttaatgtagtggccgaccggattgtcgactgcttcactgaattgaccggcttcctgatcattttgatcaagcgcgtacgcaggacggcggtaaatcttgccttcccagggatacatcgtgttaatgtagtgaaaatcgtcgtaaccggcaaattcaatatgctgtggtacctggatcgcatcaaagtcactgctgtcaaaatcagcagcataaaagtttttgatccggtgcattggatccttggcataggcgaattgccactggccgttcaagctttgcacgtaactgctgtgattatttcgaatctcatcagcactctgataaaattgatgatcgctgtgggctggcagcataccgaccctgaaagtttcaggatcgtctaaccatttaatgtctggttccatgaatttatcacactcctcttgcttagtctgaacactaattctaatgtaagcgctttacagtattttgtcaataaacatttagattattcattaaacatttcattaattttactaaatatttaattgggcataaaaaaacaggccccaaaatacgggacctgattctaattcatttgagcaaagctattttccgtcttgaccgcggttaaagcgggcgttgggctctgaagctaacatcttggagaatacgtcagtcaaactctcgctttgatcttcaaatttcttgttcaagaccagttgacggaagtcttcgactgaaatatgttcaacatccttgaatggtagcggcgcattgatatcaccagtgttctggtttaacccagtcttcaatgtgataatcaagccttctttgctatccaaagtgacaacgtagtactcgtaatagctgggagtctcatagtttccggttaaatctttgtggtccttgaagtaatcgtaaataaaatcggcaaacgcctctttggactgtaaagcttgtttccaatcttctgaattaacagacattatttatccttctttcatcaaacagtgattacttaacccgtttaatcatggcaatcgcaattccaccaatcagttccatcccaatggcgaagataaagattgcgccgtaaccaaaggcttcaacaattgctgaagcaaccatggcaccaagcatttgacctaatgtgttggccaaattaatcaaacctaaatcttttccggcagtatcggatgatggcaaaacatccatgttcaaggcaccatcaacagagttgtacaacccattaccaaacgcagcgataacggcgtaggcaaacattgcccatggttctttgacaaacagtgggaataatgcggcagcacccaaggcgaaggttgcaatcacaactggggctttaactcgaccaagtttatcggcaagtgggccaccaaccaaggcaaagaagacaccgatgaagagcatgatcgaactaaagattgagattgacgttccggcttgtccagtactttgaccaatgtagtcggtaaagatgaacagcaggaaagttgtgacaatggttgaaccaacaaccatgaagaacttaccaaataaggccagatagaagtcgcgggcatcatgggttgggaagaagaaatatttcttcaggctgtccttgtcaaacttgactttaggctcgtccaaattacccttttcttgaatcagcagctcgtggatcagggccaaaataacggtacatccggccatgaagtaaataccaaatttaacgttgccgaggaactgggccgctaacaacgcaaacccttgctgggcgatggtaaagccaacaccgtagaaagtagaaaccgtcccacgccattttggcgcaacccgatcagaaatctgcgggtaaatcgccgcggcaatcgcgttttcggccgcagccgcaacgatccaaatggcaataatggcaacaattgatttcatgttggcaattaagaccaacgaaatcgcgatggcaatcgttcctaagacaatgtatggtttccgtttaccaaatcgtgtccgggtaacatctgacaaggcaccaaacagtaagttggtaaccgcaccggtaattgaggcaatcgttgccaaaataccaactgcccaaactttatgtgccggatccaattgagcaaacaattgggggattaacacgcttcgagttgatccaattggaccataccaacagagcggtgctaaaaacattgcggatgaaatcatccaaggtagcttgggttgttgttcatccttaattttggcgttggtaacaactccaacagttgttttgacagcgtctttttcttcatctttcttagccatgaatttcactcccgataaaatattattgtggtaccaaaagttttacgcaaacttcaatcaatcacttactggtcacgcctcctcagttcaatcatccgataagcgattagtcggtggaaccgcattaaccgcttacatttcacttcaaatataaaagcattcatttcccaaagttcacccagcaattgataatgattgataataaatggctgtatgtctgtgccggtgcgacattcaacgattttgaacgtcctgagaaaatttgaacacttatatatcagtgacttcataataacgttataggaaagcgctgtcaatatgtttttcctaacttttactaaaatatttttggcaaaaggttttaattccctataccattagttcctgcattggaacaacgttgtatgcgcttatattatttagtgcggacgatttacataggtttgcaaattgatatgtcagttagaatttattgtacttcctgaaaagatcggttattctttcattattttttagtaaagtaaaaggctatcggacgataactgcccaatagcctgattcaacacctattcaattgttatgccaagtacatttcttgtagtcgtgcctgttgttctttggtgatgtgcaacccatttgtgatgaaatcagcaaccgagccataatcacgtttaacttcatcgatcgcagctttcaagtaggacaaatcaacgccgccatcgacttttgcaaacttaatttctgaacgggtggcacccttttctttgagccgagcgattcgggcgtcaatccgtggcttgagaaaatcgttggaggccacgtaatctttaaaaatggtcctggaatcaacccctaacacgtagaggatcaaagcagcagcgacaccagtgcgatccttcccagacgcacagtgccagagcagtgatttccccatgggcttctccagtaaagccataaatagattatgatagacctttctcgcatgttcggacgtgacataagtccgatagtgcttgcggttgttttcagcattaatttgataatagtaagtctcgcgagtgtcaacggaatcgttaatgtatttcacgcccggcaaggagcggtcgggcaactcactgacttcttcggggcgacgcagatcaaagtcgacgcccaaattataagtattaataagtgtgttgacgtctgcggaggttaaagcattcaacctggcggatcgcaggagtaagtggctcttaacgaccagaccgtctttggttggatagccgcccatatcgcggacgttgaaagccccttgcaagtggatttcatgttctttcacacttttcagggttcgcaaagcaggctgactaacggaaaaagtgttggtggcctccccggcagcggggattgctccttctgataaggccgaagcgacaaatgattcattttgttctttcatgtaaaaccctcccaacattgtcaatctcgcaacttccaatgtaacacttttagtatagaagggtaatgtttttgcttggtattgattgggtaaagaaatggtaaaaattagagcgcgacgagacccggttaggacccagaacataagcgaaaacttccaatgatgaacggtctttgttcatcattggaagtttttgtttatgtggccgggtcctgggtcgtcggagcgtatttcagaagccgaagggtgctcaaaataacataacaaacgcgccacagcgcgacgagcaatgggtggggcggtttctaaggggactttgattgaaggccctggtcttggggctttaattaaagtccccttagaagttagccccagttgcgtcggagcgtatttcagaagccgaagggtgctcaaaatagcataactgctcaactatacacattccaaaaaagtcccccacccagcagcaagtcactcacccatcacatcttccgccagaccttcagcataatcagcatcgccacaatcaaggcgacagaaatccccaaagtcagcatccaagcatattgcatcccggctaacgggagtttcacgttcatcccatagaatccggtaatgatcgttggcacagccatggtcagtgaccaaattgtcaaaaatttcattgtgtcgttcaggttgttattagcaaggctgttgaaggtatgatcgattcggtcaacgacttgggtttcaatctcaaacatccgttggacctgttctccttcaatttgcacgtcttcgaataaatcaattttatcttggtcagcaccgacaccaaaatgggtctttggcaaacgatcgagttcactgagattggtttggaccgcgctggacaaaaaggtcaacgtctgttgaagatatgaaagtgagaccaagtcactgttcttcgtcttccggttcaacattttatccaaatagttgcgtttcttggtaatgccgcgagaaattgggataaagctgtcaacaactgcaaacaatgtttccagaataaatgcatcgacgctcttaacctcgggattatccaatgccgagtaaagtgccgtgttgacttcaggaatgtggctttggttaaacgtgaataaaacgcccttgtgaagcagcatgccaaatggctgggtaatgtatctcagtgcatctttatcgagtgcatacggcgccagaaagatgaataattggtcgtcctcattgatatcataaacataattagtactttcatctttatcagtgacgtactcaataatatcttcatcaatgccatactgatcttcgagggttgcccgttcttcggcattgatttgaatcgtttcaatccatttggttccattgattgtcttttcgggtttgatcatttagtaatccccctgttagttattaacctctattttagactaaaagaaaagaagccgcagacaaatttttaaattgtcaacgactcccaactgctaaacacttttataaagaatataacggaaacctacttattttttataaaggtctttaaacggttatttcagcaagccaaccgtctggagaatcaagtagatgttcaaggttaccagcacaatggtggcaaaccaagcagcgtacttgacccaggtatgattggcgaactcacccatcaacttcttgttactggtgaacatgaccagtgggatgatggcaaacggtaaagcaatactcaggaacacttgtgatgccgtcagtaatccttcaatcttagcctcattgccgtgatagtaaatggcaaagatcaaaactggtgtgactgaaagcagacgagtaatcaatcgttgtgcccaaagtggcatctttagatgaatgaaaccttccatgatgatttgtcctgaaagtgtcccagtaatcgttgaactttgtccggatgacagtaaggctacggcgaacagcatactcagaattggactggcaatggcgccaacaatgtgtgaatcctgcaaagcgttgaataaatcaacgaaccgaccaactgaactgttcgtaccgaagaacaaggcagctcccaataccagcaataagctgttaacgataaatgccagtgacaactggatgttggaatcaatcgttgagaacttgattgctttggcaacatcctggcgattcttccggtcaacccgacgtgtctgggaaattgatgatcccaggaacaaatcatggggcataaccgtcgcaccaacaatcccaagtgccaggtagagcattgacttgttcgtgacgatcgatgttgaaggaatatagccggcgaacagttcaggcatattcggtcctgccaagaatacttcgtatgagaagaccagtaaaatcactgcaaccaaggtggccacaatggcttcaatctttctgaagcctaatctcatcaagagcaacaggatcaacacatcggcactggtaatcaaaatgccaactactaatggaatcttgaacagtaattccaacgcaatccctgaaccaataatttcagcaacatccgttgccataatggctaattcagtgatgatccaaaggataaatccaactcgcttactggtacgttcacgggtcaactgagctaaatcttttccggtcacgattccaagtttagctgccatggattgtaacaacatcgcaatcaaacttgagatcaagaccactgataacaggctgtacttgaattgagccccaccagcaattgatgtgatccagttaccgggatccatatacccaacggcaatcagaattccaggcccggtataagttatcaacgtccgccaaaatcctgcatcttgcggcacgatgatactaccgttaacctcatctaagctcttgctgtcgccagcatcttctgtactactgaaaaacttcttcttaggttctttcatttccacactctctcgcatgtattagccctctttcattggtttgaattcgggcaattgtttgagtagttactcagtcaattaccaacacttattatacacacggagatataaaggtcaaccattactctcaaaagttttcaagaagccgttttcatggcatttatcaaaaatttacatgaaaatcagctaagcgacttttaaaatactagattgagtgtatacttaatctgaaatttaaattcaatgcacagtaaggagccacaatgaatgctgaatggtaccgaattaaaattatttgctgatgccaacgtgctaaatgcaatgaccgacaagcaggtcaaaatcctattggcagcaatcgaagtattcgcagaaaaagggtatgccaacgcaagcaccaaagaaattgccaccaaggcaggcgtttccgagggaaatatttttagtaagttcaagaataaacgcgggttactgaatgccatcatcgaaccggtgatcaactcgatttttcccgccgtcctcaccgaatttaagactgatcagctccccctgcaatttgtcactttacatgcctttgttgattcattggtccgcgacagaattcaatttctcaaagacaacgcagccgtcctcaaaatttttgtctccgaggtcttatataatgagactgtcagaaaagaactgctgaccaaatttcctcctctatattggcacaacatcaacaaaaatttgaatcaactcaaagacaaccatttaatcgtcaactgggacaacctagaaattctcaaaatcatttggtcggttgtcggcggcgtgatcattggttacctattgtttgatcaacctctggagcagcgagaaatcacccacatcatcgacgcgttggtcaagtctcttgccagataactcttcacaatattaaaagctgaaattcaatgatgaatttcagcttttttaatgtggaaaatgataatttgctcaatcattatttgatcggataacggtttcatccccactatgacaatcatcatcttgcgtgttcaatttaggggctccaaacacgaacattaaagtcaaaaaattaatttcgaattattgttgataattacaaagctagtgtttatactaagcattaactagcgatgcgaattatttatttttatttcaaattaatgttcgtgtttagccgaaatttaacaaattgaggagaattcttaatgaaacgcaatgataacggtttgctttacggtccagacgataaggtttcatatttccaatcaggattactgggactccagcatgtgttggccatggatgtttacgtgccaccgatcatcattgccgggctgctgtcaatgagtctggcacagaagaccggcttcttgcaggcggctttcttggcctgcgggattggaacaattcttcaaacccggtacttcatgaagctgcccgtttcgcaaggcccatcatttgtgccaattggtgcggttgccggggtctacttggcaaacggtgccgctaacggcgggatggcgactgtcctgggatctttgattgtcggagcattgttattaattctgcttggcgtttcaggcgtctaccaaaagattatcaacacattggttccagcaattgtcggcggcaccatcatcacctgtgttggcctgtcgttattaccgtccgctttgaatgacaatatcttcaaggcagccggcaacgtcaaccaaaacattgaaattgctgccatcaccgctttggcaatgttggtcgctattacaatcggcatccgcatcccccaacttcaacgattgttcaaagtcagttcaatcattatcgctttgatcgtcggtacggtcgttgcttcgatgatgggccgtttcgattggtcagtcgtgaacaacgcggcttggatcagtctgccccactttacttcattacattacgggattcatttctcactgccggcaattttaaccttcgtagtgatttatatggtattgacaactgaaaccaccggtacctggttcgcaatgagtgccgttgtcggtgaaaagatcaccaagaaacaatggaatcgcggaatcattggtgaaggactcagctgtctgtttgccgccctgctcgggacaaccccaatgaccggatactcaaccaacgccggggtggtttcgatcaccggtgttgccagcaaacgcgtcttcgtctcagctggtatctggtttgtcgttcttgggttctttggtaaattatcagcgttcctgtcagctgttcctgccgctgtaatcggcggaatcttctccatcatttgtgtcatcatcatgttgaatggattgaacgttatccgcaacctggccactgatgaaagttccatttatgtcttagggattccaatcgtcttgacaatggctgtgattctcctgccagccaaagtggttagtgaaacgccacaaatggttcagtacctgctcggttcacccatcacgattgccgctttgagtgccatcattattaatctggtaatgggtaatcgaaaagtctctgaagccacggaagattcagaagaaattaaatcaactgatgcgccaaaagaacaattagcagaatcaaaataatcattaaatttaaaaggggtcggacatagacattgattgcctataatccgacctcttttatgttgacccgttcaattaaacttatttggttaacttacgataaacctcatcggcaatcaagtcgttggtccacatccagacaacgtggcccaaagcctctgacacatgttcctcaaccggttgatctttagcagacggaaccgtgcccattgccggcatgatgcccaaatgaaaggcaccccagacaccgaggccaaacaatgtgccgtcgcccattttaatcaccggaacataatggccggccagactgtaaaacattgcaaacgaagttgaaaaaccaaagtggatcatgtagctgacccatggtaattgctgatcggaataggtgtaagttgcgtgagtcacctgttcaggaattccggcctgctcaagtaaacgctgtggcgggttggttttattccgttcaggtgtccgcggcggcaaaacattttcccagcccaatttgacgagaccggaaataacgccggcaacacccccggcaattaaggcggctttccaattaactgatttgctcataagacgatcccctttcgacattaacgttaatttcattatagcccactcaagccaagttctctgtaaaaagagtcgatgagcgtttatatttgcaatttctacgatgacctgttaaagtatagataatgtatttagcttcgaaacaaggtccatcgttctaataagaatgactccttacttttcaagtttcaaatgcaaaatttatcgcgctatgcgcaacggaggtttcattcttatggaacaaggtactgttaaatggtttaatggagacaaaggttacggttttatcactttagaagacggcaaggacgtttttgttcacttctcagctatcaatgctgacggttacaagacccttgaagaaggtcaaaaagttacccttgacgttgaagacagcgatcgtggcccacaagctgctaacgttactgttgttgaataattaaatcaaaataaataaagacccctgtgagggtcttttattttgcccaaaatgtgttggaattcaggtcccagcgcatttttttgtggtcaaaaaactgtcgtgataaccgcaccagagacaatcagcaataaaccaaagattgtaaacgccagttcacgaggcgtctttgtttcgtgcatccaaatcatccccagcaacgtcgagatgaccacagccaactgcgaaaccacaaaggctgaattgacaccatttgcctgaacggaaccaatgtaagaaattgcgcccagggagaagaccagtccaccggcgatattcaaccagctgaccggctctttaataatccgctgctgaccagtgacgaaaacatagaccagaaccgccagcaggataccaattgcttctgggaaaaagatcgccagtcccgaatgattcagtccccgaggaatggccatatacacaacgtatcccaaagtcgtcgttaaaagcatcagaatagttggcagcttcttttgcggtgtcctttgggcaaccagtggcttatcggtgaccgatgtcagcataatgccaacaatcaaaatcaggatgccccctgcacccagcagtttttccattatcgtcgaccattcaccaaagatcacgacaccgaccagtgaggtgccaattaattggaatccggtggaagttggcatggtggtggataccccaatatttttaaaactaatgaactgaccgacttgaccaatgacccagaaactgccagctaggactgctgctaaaaatgtcggcactgaaaggtgtggatgataaaaaggcgtcatcaccgctgccaccaagagcgtgccaacggcagttccaaagatttgatttgcgggcttgccaccgatgcgggcaacaactggtcccaaaagcccccagccaactgccggcagcagcatcaacagtacattcatctaaccaactcctatttctaattcgcaagattatctgtcacggccgatcaagctggtgcctatcaaagccacccagaaaactggcatcaaaatctcggtgactcttaagataccgcttgccgaactcgtcaattaagccgtggaattcctgagcatcctgatatgtaaatgattcaggcagccaaattcgcttttggagtttcgaataattgctgagattgcgaaatcccagatccgtaaaaagcgttctggcatatttgtcggcaataaacgccggctgatcaaatacatagaccaacagcgaatcagcggtttcctcccccactcctggcagctttaacattgtccgacgtaagttggatccatacttatctaccattaaggcaaagttgcagtcgtcttggtcaaaccatttgaggacggcttggaggctgcgggtcttgttgacgtaaaaaccactggggcggattaatgactgcagcgtttcagttggcaggcccaaaatctgtttcacgttcaaatgcgtctcatcttttaaatttgtcagagccatatcgacattgttccaattggtgttttgcacaaggatggcaccgatcacaatttccattttcgaatcggccggccaccagtgctgtggccccatctgttggaacatctccttgtaaagtggtaccggattaatcatggagacacctcctaaaatcagctacaatcagtataacagtttcggtcgtggtagcgctaccacagttaagtacgctatactgagggtatcacactaatttggaggacactatgactgaacaagaaaaaatgttagccggaaaaatatatgatcccaccgatccactcttagctgctcaacagcaccaagcgcaccgactttccaaacgatataacgatacctttgacgaggacaccgaagaacgggccaaaattgtggctgagctgcttcctaatgccgataagggtatttatcttcaagggccaattttcttcgattacggcatttatacaacgattggcgcccacttctatggtaacgccaaccttacaatccttgacgactgtccggtcacgattggcaacaacgtcatgtttggtccaaacgttaccttgtccaccccgatgcatccactccgctatcaggatcgcaacctcaaacagcgctcagacgggtccgaatacgatgatgagtacgccaaaccgatcacaattgaaagcaattgttggcttgccagcaacgtcgttgtcattggtggcgtcacaattggcgctggcagtgtgattggtgccggttctgttgtcaccagagacatccccgctaattccctagcggtcggcaatccgtgtcgggtcattcgaacaattaccgcggacgatgacattcatctcaaatcaaatttattttagacaacaaagaggttgggacgttaattgctacggtggctttcattgcaactttgattaccacttgtatattgataaaacgtgcaacgatcggctgatcccggccatttaagcaaaaaagcgagccattccaaaacaggaatggcccacttttttgcttaaattctgggatcaaaacgcctcgcatcccactcttttttttgaaaaatattaatgtgcttgtttgcgaagcttgtgtgattgataagtcaagaatgcccaagcgaccagaccgaagaagattggtccgatgatcgtccagaaggcgttgacgtaatcgtgttccaaaattgggtaaattgccgtgaacccaatcccaccgatcaagacaatcaaaacgatgattgagatggtatcggtcatccaccgtttggtataaatctcaaacggtcgttccaggttctgcttgcgtttgaagaatgggaaggcagccaccaggaagatatacgggaatgaagtggaaatgtttcccatattcgtcaaaatcacatagaactgcttagcacttgaaccaccaaaggtcacgaagaagatcaggacggcaacaatgaccgcttgggtccacattgcaaatccaggcatccccttcttattcagcttagtcatcttagcaggccagaagttgggatttgagcccatgatgaatgacttcagtggcgagtagaccagcacgaagaacgagcccatataagccatgaacatactcaacccggcaaagcgggcaaaagtcgtccccaagatggtgctggcagctgcagaaagatgcagactctggcccagcacaacacccaggttggccatcaagacataggtaatgttccccaggttaacgtgaccatttccaaggactgaatgccaattggcagtgatcccccagaggaagatggaaagtgaatacatcacggtgattaccaaagtggaaatgattaacccgcgtggaaatgttttttcgggttcatgcatattatcggtcacaccaccaagagtttcagttccggcataggcaaagacggcataaaccatgaatgaaatcaaagcgattggtgactgaaaatcagggttcggcgattgaataaagctgtgcatcccggtaaccggttgggccaaatgaccgccgtttaaaatcaaaacggtgacactggcaattgcaaaaatcaccgtcagcagagaaacaaagattccgcccaccgacgaaattttggaaatcgagtccattccgcgaacggcaaaccaggttacggtgataatccaaagaatggccagcagaccaatcgtcttggtggagctcaagccaaagaagctccagctctgagtcgtatcgtgaccgaataaggttgtcgcaaacggaatccagactttagaagcggtggacatcatccagataatccaggatgataaccaaatgaaggtgccaataaaggcccactcttcgccaattgacccggctaaccaggaataaatcccgccatgggcatctttgaaagttgacccatactcggcgaacatcatagcagttggcagcaggaacaagattgcggccaatacgtaccaaataatacttgcataccccatttgctcataagcaacggtggtattggcaaaaccataaatcgtggtaaaaatcattaagattaaaccaactaacgtgatctttttcttcgacatagctagattccccaattataatattttgaaatatgtaattctggtgattgttaaaaatcaaactaaagaatagcatgccattattaaaattaaccaacaagagtcaggaacaaggttaaatctccattaaaattgaaaccggttcatccgttgataagcgttagtttccccatttaccattagagttgggtgaatcttaagcaacaaaaaagcactattatcaggattacccaacaacagtgcttcaaatattatctagttagtccaacttagtcttgctgacaacgtttaatttgtcatcaaagtcataaaccactggctcaccagtagccatttcaaggttcatgatgtcttcgtcagaaatgttttcgatgtactttgaaagtgctcgtaatgagttaccatgagcagcaataatcacgttcttgccgtcaagtaatttaggagcgatttcatcttcccagaatggcataacccgttcgagggtaaccttcaagttttcaccaccagggataatgtgtggatcaaggttggcgtaacgacggtcatgaacagctgaaccttcgtcgtcggccttcagaagtggaggcaatacatcgtatgaacgacgccagatatgaacctgttcgtcaccatacttttcagcagccttcttcttgttgtggccttgcaaagcgccgtaatgacgttcgttcaaacgccatgatttaacttccggaatccaaagttggtctgagtattccaaagcataatgtaaagtcttgattgctcgagtcaatacggaagtaaacgcaaagtcaaactggatgccggcttttttgattaatttaccagcattgatggcttgcttaaccccttcttcactcaaatcaacatcaacccaaccagtaaactggttagataagttccattcactttgaccatgacgaattaacacaagttttgccaatataattacctctttctttatctctatcagattgattttacaccaaatggaaaattttttcagcttaattgtgaaacttttataaagtgaatccggtttctatggttcccccggcttggttgggactttgtcgagtttgccttcatgcttcttgactcccaaaatatcgaggaagaaggtgaaaataggcaccccacaaattaatccccaaatgccaaagaagtgctcgccgatcaataagacgacaaaagtatagaaaattggtaagttggtcttggaggccataaaattggggttcaaaatgtaagcttcaaacgcgtgcacgacaatgatcgtgatcaacaggtaaaagacatcattccacccgccgactgaataccccaccaatgacaacggcacaaaggaaataatcacgccggccactggaatcaggctcaagatgaagaccatcaatgccaaggctgccagttgcggcagatgcatgaaagccatcacgatggtggtaagaactgtgttgcagatggcgatgaagaattgcgcttcaatcacaacaccgaacgttgcgacaaatttcttgccaaagaagtacaagtcttggaagaaccaaccaaaatcactttcaagaaacagtttggaaaatctggtcatggttcgctgctcaatggcaaaaaagaagctcaaaatcatcgacaagaacagcgttattcccatggtcccaacgccggtcacatatttccaaaccagcgacatgccatttttcatctgagccatgatattactttgcttaatcagttcattcaaccagctcatcgtagtatcatccggtagattcttggggtcggtgtaaaagaggataatgtcctgtgtcgttcgaatggtttgatcagcaatctttggaatatacttggtcaccgtaaagtacaaccccaaaattaccaacaagtaaacgaccgtgacgataatgcctgccggaattttgatgtgcctgcggattgcattggttaatttaaccaccaacaaacagaagataaaggttaacagcactgtgctgatcatgctccgggttacataaagcacaaaaatgaccagcatcaacacggtaaatcttctcagtggtacgttgttgacgaaccttgcccaaattgacaaatacccaaccccctcgtgatttctaattaaaattaattttactcttagaaaacggtttctcacaagtattattacttagaaagggagtgtgccaaaaggcggtcttgcttccgttgcataacctagaatgactttttgagctaaaagctcggaaagttattctaggttatgcctaggaagcggccttttggcacacgttccagctatataaaatgaaacaagcaaaggggctgttgtcaaaacgttagttttgtcacaacccctttaccgaatcttaatatcgggctttcacgtactggccgattgtttcgccattcttatgagcacccttgatgacgtttctgacatcctggtcgctcattgcgttggaatcgacaccagcagcactgatttgctttctggcactggtgatctgagcagccgtaatcggtttgccgtcaagatcgcggtcgcccttggtcacggtgtattcatttgagcccttgtaggcagcggcagctttcttctcagacgacgtcaaactagcacccttagcgccggaaacgttgggattattgctggtgttactgtctgatgtgctggagtcaaaactgttggaactagcggaagcattgccgctgatggcatcattgttcttatcccgcaatgtttcggccttcttcagaatatcggcatagtacttttgatgaattgatttatcagagaaaatcttatccagcgtactgttggactcggtgtactgcccattaccggcctgatccaaggcttgattataaatcttgttgtagttttgacggttcttttggatgcctttaatcttggtaatttgtgctttggcacgatcagacagtagttcattacccttcttggtgtcgacgactgactgatactcactctttgcctgaccgaatttaaggtcgtcaaataaatcgttggcggaaataaacgattgcgtttggttcagtatcttatccgctttatcatcattcggtttgcgttttaaggcattggtaaacgatgtttcagcagcggtgtatttttcattcgaaatttgaaggcggcctcgctgcatagcttcagcgtaaattttttcgttttggctatgacgggcatatgcgtaaccaccaactgatgcaccgataacgatggcgattacaatccagatccattttttcaaattgaagccctcctaataaaatttgttcaaatttattataacatttttccctaattggcattttcactggcatgccatgattcacgatatttggaaaaacaatcattagagactattataacaaatgacagatcgagactttgatcaaaatatttgttatattaattttaaagatttgaaaggagcatgcaaatggctgacagttcagaagaatatattaagcagcacatgtttggcaatcctcagatcaagccggatgagaaacgggcatttcttggcaacttcagagaacgagtcgccttagcgctgacgatcggccagctccagcaagccggcacggcggaaatggtcactaagatcttaaaaaactatccggaataccgcctctacatcaacggccggatggaccaggacttgatcgacccattcatggacattgcgattaaagaaaattacaagtacaccattctcgtgcaaaacgggatgcgggtcgaccaacgcttgagtcccgacgactttggcctggtggtggccaatccgactgagaaaattaaaagaagaattttactgtaagaatttaatccaaatagattcccacacaagtccaactagattaatgaccagaaataaaaaggtcgagagataggtaaaatcacctttccctcgacctttttgtatgtaacttgtcgctcatcaaactaccattgccaagaggaaaacagcaaccagccccaaaacaaccgaaattgccatggaacgagtccaataagcaatcccaatcacaatgacggccgcaatcatctcaggtgcccggttgacgatggtaacggtatattcaggtgaaatgaaaatgtccttgacaaccaacgccgtgaagagcgagattgggacatatctcatccattcgttaaaccaatctggaatttttcgggtacggaaaaacatcaggggaatcagtcgcggcgcaaaagccacacaaaaacaccccaagattaaccatacatgctgtgttgtgttccattccataaagatagctcctagtcatcagcgtcttcgtcggcgtcttcaggcgatccggcagggtttttcatcggccgcagccaaccactcttgggtttgtactttctgatcgtcgcttcgaccaaaaaaccaatgaaggatgctgtcaaagtggataagaccagccccaacgtggatttggtaaggaccataaagaaagccgccaagaatcctgataaaatacaaattacaataatcaacccattcttcagctgaaccacaatcatatacaggaaaagcgcggtcagtgcaaaatggacaattgttaaatcaatgttaatggccgacccgattagactgccgataatgttactaattgtccaaaagatcagcgtcatgtgttcaacatgtagtgcttcatgaggggtaaacttcttatccgtcgaaaattttaaatagttcaacgcgtagttttcatcgttcattgatgccgcaaacaatgcagtaaaccccaaggattctccatgcagatacttggaaagactggaccccagcaatgcgtaccgcagttcaagaaagaacatcattaaaatgaccgaaagcatcggcgcattagtggccagaagagacgcaatcaagaattgagccccaccggaaaagaccatgattgaaaccattaaagtggtccaaacgttaaagccggaagcgttcaataaaataccgcatgccagcccaattggaatataactcaaatctacaggcaaagaagcgtcaagaattcttcgccaatatggcagcttctccctagattttgcgacagcttttcccaaaaggattcctccatctaaacccatctcacacattcgtgacatgtgtgtaaaaataatgtaaacacaatccaaatacaattatatgggatatgactcaattaataaacaccttttgtgtaattgaattttaaaacagccgtaatatcgcgcgccataggcgaacaaagaaattggcttttttcacagattgattggtcaccatcaccagcttgccagccgagtggccaatgtattgcaatcgtttgccgtcaatgctcagccgagcctggcctacctgagtgccctttttagtcggcgatgtcagtttggcaggctgattaacgtattgaccagaaatctgcttggcagaagtgcctttgtcggcccaagcccagtgggtcgccttggtaaccggcaagatggtcgtctgtttgccatcgggaattttagctttatcgaccccagcgatcgtcgctccggctgccaacttaatcggttgatgagtagcataaacccatttcatcaacttggcggtttgaataaaccgtgccggatcgttggcggacttgtttctggcacctaacaccactgtgataatccgatgctttccatttgtcgtggccgagccaacaaaacacgcccctgccttgtcggaggttccagtcttcaacccatcaacgcgaacaccctgacccaaattgtgatcatcaatcaattgattatgtcccgtcatggtggtcccataaaatgttgacgtcgtctgctcggtaatattggtcaccttggggaacttttgcagcagcttttgagccagcaaagcaacatcttttgccgacaacaagttttcagcattggcactgacatgtgataaagccaatttaccggttaacttgttggtcaaaccggaagcattgtagaagtggccatcggaaatgcctatcttccgggcggttttgttcatcaacgcggcaaatttagttgcagtcccagccactttctggccaagtgccaaggcggctgcattggcggattcgaccaaagtcgcattgactaattggcggacggagtaggctttgccggcggtcagcggtacgttggtgagaccggatgccgtacttaatttggcaagttccgatgaaattttaactttgtcatcccaggccagtttattggccctgatttgctgatgaacgatatagacggtcattaacttggaaatcgacgcaattgcccgcggctgattggcgttcttctggtataaaatttggccgctgtcggcgtcgacagcaatcgctgatttggcataaatagctggttccggggtaactgtcgacttggcatcaaccgtcatcgatagtgttaaaacgcaaaaaaagcccattaaggccgttaaaattttgattcgatgcttcataaagttctccttttattcagcaattttttggcggggctttttgcttaatttatcaccatgttgaaccggtaaatgaatcgcaaaggtcgtcaacttttcatcggagctgacattaatgtagccaccatgcaaatcgatgatactctgggcaattgccagtcccagacctgagccgccggtatccttattgcgagagctttccacccgatagaaccgttcaaaaatttgatcaagtgatttttgcggaatctccggcccatcattggcaacgtgaatgacaacttcgccaggttggccgactgcggcactcaaataaatgtggtggccgcccttgccatatttgatggcgttggaaatcaagttattgaaaacccggcccagcttttcggcgtcggcctcaatgtataagggcttatccgtttctttagcagcaattgccagcccgcttttatcagcttccagctcaaaactggccacgagctgttccatcatttgattgaggtcaatcttactgatggaaagtggcgttccggtctgtttgaccttggtatattcaaataaattatcaaccagggacttcatttgtttggccttcaaataagcaatctcggtatatttcagcaaatcttcctgactgtgatattgcttatcccgaatcaagcccaggtagcccaaaatagaggttaacggcgtccgcaagtcatggctgacattggtaatcagttcgtccttggaactttcaattgcccgttcctcgtccattgacttgatgacactgtcaaccaaggcgttgatgctttcaaccaccgattgagtattaccactcagtttaaagggaattcggtgattcaaatgaccattggcaatgtaatgcagctcactgatgatgtgacgcaactgcatttggtggtaacgtctgatcagccgccaataaaccaccgcaccatcaaacagcagcaggaggacaataaaaatattctcccagctccagagatgcatgtggtcggggccaattaaaatcgatcgtttgataatgaaaattccgtcccgcagccctgggttggtggagattgattggttaattaaaatgatcactgaaaggttgagcagcaaaagcaaaatgactgttacgacaccttccaaaaacagctcggttttctcacgacctgtcagtttcatgcggcatcccccatttcaaaattgatttggcctaatgggactcgatcttatagccgacaccccaaacagtttgaatgactttctcaccgttagtggcttcttcaattttgtcacgcagatggctgacatggaccatgacggttttggccgagacaatgctctcctgtcgccaaacccgctcaaaaatttcgtcagctgaaaagacccggttgggatggctggcaaggaggtataaaataccgaactccaaggcagtcagctgaatcggcgtgccggtgatcgttttgacttcgtgagaatctttattgatggttaaggggccaatgtccaaaacatcgggcgtatcgttagtgacgtgctcttcagtccgccgcagcaacgacttaacccgtgccatgacttccagaggattgaacggcttggtaacataatcgtcggcaccgctgatcaggccctgaattttgtccatgtcttcggtcttggccgacaagatgatgatgggaatctgagaatccttacgcacttctttgacaacttcaatcccattcatcccaggcatcatgatgtctaagatcatcaaaccaatgtcggattcagtccgtaagcgggtcagggcttcctggccactgtaagcggaaacgggctcgtagccttcatttcgaatataaatttccagaagctgagcaatttctttatcgtcatcgacaactaaaattttcatagtgtaatcaacctcattatcgtctgtatttactattattttatcattattatgtgtctggctttatcaattagcatccagttttgattttacactttttaataaattcaacaagcatgtctgaaatgttactgtaaggcgtttgcacaacgtttacaaggatagcatcggaagcttaaggggaacttaaaaaaagagagtgcgacgagacccgggagatgcggtttctaagagtgctttggttaaagccccagggcttggggctttaaccaaagcactcttagaagttagcatctgggtctcgtcgcacgtttccgctaggaaacaaggacaatagcacagtaaaatcatcctcacacaaaaaccaccaagtaattccaggaagtgggctagaaacttctgaatgaggaagcttttggccccccaattgttggcctccggctacttggtggttttattgagtggttctactgtgttaacgattctctttggatgtgtcctcttacctatcagaaacgtgctcaaagccccaggactctgccacacaaacaattaaagccaacgatgaacacagaccgttcatcattggcttacttgtatctggtggttttacttggtggttctaccatgttgacgattctcttttaagatcttctcttacctagcagaaatgcgctccacaagccagctttctccgcttagtccgataacgggcgttaacgcaggaccagcgttaacgcccgttatcacactaatgctcaaaagctaaacggcttgttccgcactctaaacttcgttcctcaaacctcccccatcagtccgcgtctcgcgaacataaggtagatcaccaatatcttcaaaaggttggtcgtggaagtgacccggacccatatgcgggccatggccgtgatgatgcatatggtgcatttcatgtgcccaatgatccacgtgcatccccgttgccacgccgaccgcaaacaataaaccaccgcaaatgactgatcttgctttcatacctgccatctccctagatgagtttttgatccttcaaaagttcttccaagtaagttcccttaacatgtttcagtaatcgctgaataaccattttttccggtggggtcaacggtaattccaataaggacttttcgtcattcaaatagtacacagaactaaggatcgatcgaatatcaaacgatgaatcaaagacctctggaacaccacggtcgacgttcagcagttgatagaccgcctccattgccgtccggactgaatattcggtggtaaagaccgtgtcacgccttgtttcagcgaagttaccgataaatgccaagttggttgaaccggctgggacaaccagcggtcgatcgcctgcctgccgcggcatgaagtacgaggtaatgtacggcatgtgggccggaatcgtgttggctgattgggcaatctcttcgatctcatcaacggggacgccaatgtggtataagaactcctcgcagatttcaattcctgagcagtcggcaatcttcttttgaacatagtttccaggtaaatctgagaacaagccataagtccagacaaccagctcatttggtttttgctgagcgaaatgtggctgacgactaaccgttagtcccatcaaccagttggaatcccgaatcgacactggcccgctggtaaccaattgaccactgtgcggatctttcttggtaatccgctcaatgtatggcacaattcgatcgtcagtgaacgtggtcgtggcagaaatcacccagttggccggaggaatgttctggtaaaatttcttcgggtgaccgaatgcaggatcctgtttagccagattctcccaaagcgtccaagctgcgccaaccgcatgttccttcgctgccggatgatcgttatccccataggtcgtactttcagtaatcgacccgttggtaatgaagacgaaatcatttggcgtcaaatcaatgcttttctccaccccgtcttcaataatctccagcttggtagcggtcttcttcccatcagtagtgtcgacaatcacattttcaaccgtggtattgaattggaaactgacaccccgatcttccaggtatttgaccatcggtttaatcagcgactcatactgattgtatttggtgaattttagtgacgacatatttggcagcgtgccaacgtggtgaacaaatctcatcaggtagcgtcgcatttctgcagcactggcccatggttcaaaggcaaacatcgttgaccaatccagccagaaattagacttgaagaagtcatcggaaaagacgtcgttgatctttaaattatccaattggtcttcaggtgtcatcactaacttggcgatttcttccactgcttttctggacagggtgaatttgccgtcagttggaattcggtggccgcgcttctcgattgcccgggcatgtgaaaaactcgggtcatccttgttcagccaataaaattcgtccaagactgagacgtcgggattctccaagcttggaattgaccgaaacaggtcccacaaggtttcaaagtgctgttccatttcccgaccgccacggacaatatagcccttgtcaggattataaatgccatccatactgcctcctggcagtgacagctcttctaagacgtgaatattttcccccggcatttgcgcatcacgaaccagaaagactgcggcggccagtgacgccagacccgaaccgatcaaataggctgacttgttggcaacaccagctggtttcttgggtttggcaaaggcctcataattgccattagaataatacataaatatgcccccttctaaagcacatctgtcatgtaaccgtttacaggggtattataaacccatcccacctcaggagggtcaaatttacccagaccgatttgggagaaaaagagctgccggaaaagcaacaactttaccaacagctctaatcatttcttaaaatgtcatgcaactactgagcatccgcttccagcaaactctcctgcaaggcagccagcttggtggtcacatagattggaaattcgtccgggttgaccaaccgctgagtggcagctggaatctcggttagtttttgtttggaatacttttgaatatcaaagacacttggaaaagccatcttcaaatccgtgccggccaaaacttcattttggagtggcttggcgtcaaacttctcgattcgctgttcccgtttggtagccagtgggttagccttcaccaccgtaatcggttgatccaaggattcatcactgagggcgataacatccgcaaaggccttgtcagtccccggttgataaagccggtagacctgcttgagaccaggcagggtaaccttttcccggctggcactgactttgatcttaggaatcattttaccgttctcaataacggcagcgagtttgtaaaccccgctgaggaccggtgaagaagcactagtgatcagcttctcaccaatcccaaagttatccaacggcgcaccctcattaaggagtgaagcgaccacgtgctcgtccagggcatttgaagccgtaatcttaacttccggcaaaccggcatcgtcgagcatcttgcgggcagccttggaaagttgactgatgtcaccggaatcaattcggattccaactggtttgtggccgttggctttcaattctttaaagactttaatcgcattcggcacgccagatttcaacacatcataggtatcaaccagtaaggcggcattgtctggataaacttctgcccatttttcaaaagaggtcaattcgtctgggaacgattcgatccaagcatgggccatggtgccggcggccgggatgccaaatgcttcggctgccaacacgttggaagtactggaacagccgccaatcacagcagctcgggcaccatacgtcgcactgtcggggccttgcgctcgtcgggcaccaaactccatcaccggccggccatcagccgagtaggtaatccgacgggccttggtggcgatcagtgactgatgattcaaaatattgagaatcattgtctcaaataattgcgtttgcagcagcggtccacgaattgtcagcagcggttctcgtggaaagacaggcgtcccttccggaatggcggatacctgacaatcgaatttgaaatcttttaaatacgtcaaaaaattctcttgaaacaggttcagtgaccggagatactcgatgtcactatcgtcaaagtggaaattctgcagcgctttgacggcctgctccaagccagcagcaatcacaaaactaccgttatcgggaaccttccggaagaagacatcgaagaccccctgctcatcggtaatcgtctgtcgatagccgttagccattgaaaattcgtataaatctgtcaacattgataagttactcattatgtttcgactcttttcattgggattaaaagtacctttaacttttatattcttaaaataaaagtgttccaaacttttattctacgttacaacgactccgataacatttcaagcgtttacgcccgcaaatgagctaatttgtacaaccgagccggccgaccgggaccgttgacctcgctggaaccaatatcagtaaagagatcttggtggcttttcttgaaattcgagttgtcgatttgatccacccgaagttttaaaaatggcgaatagacccgccgagcatctttgagcgtgaattgtcgcccaagaatcaacaggatattaggctgataatccagtttgttgcgaattcgctcacaggcaaccttcaaaatccattcatgatcaaatgccaggtgtttgtcaggatcagcgttggtcccgccaaattctgcatagtacgtccgttgaaccgggcaatctgtggattggaaaatatgatccgaatcgctaaaggtgtacgttttatccgtatatcccatggtgaaccaccgggcatccgaggcaccataacccgccttgagctgcggtttatcgggtaaaaatgtcatgtaccccaaagacagtgcccgatcgccaggtgtccgcagaggattggtaaaggttgccaactgttcagtgtgactgcctgacaaatccatgccaatcttttctcggactaggcgcaacgcagtctcttcggcactttcctgggagcgcataaaggtttccggtaatgcccagtagttgttgtaaggatcgttatcgcgtttgaccagcagaatattgacccgattggtggcgtggtcgaagctccagattaaattagtgatggtgataaatggccgttcaagaatattttgtgagtccaacggtatgcctcctgccttgatgattaatgttactaacagaatcataatactcctatttagtaataaaaatgataattgttgtcgatattgatgaaaacttagcattcctctcgtcctgtaagtactaagaggcagctcaagtgggaaattttgctggtttggctctgcctgccatagtggctttgatttcaagcctgtagtcttgaaatacaaaggtgttgtaattgccgatttcatcggcttcaacaacactttcactatggctgtcaatgccaaaccagcaaaattcggcctcattccgtttgattcacgaatcgtgcagttccttttcaatcacttttatccaaactcatagatatgctgccagtagccgggttccagtttaccggcattgccagctgtagtgtccatgctgttgaaacgactgcaagtcgtgattacagcatcttggcatttcgagactacaggctcgaaatccaagccactacagcaggcggagccggtgaactggaacccggcgacattttaaccaaacttggtttgaagataaaaaagcaggtcaatcgcggatagcggttgacctgcaggtgtttgagatgcattaatcttctggtttgtagttaggtgcttctttagtaatgttgacatcatgcgggtgagattctctcaagccggcattggtgatttgcacgaattgggcgctgtcattgagatctttgatggttgctgagccagtgtaacccattcctgaacgcaggccgccgaccatctggaaaacgatgtcgttgatgctgcctttatattcggtttcgccttcaataccttcaggaactaatttgttggcttcactgacaccgccttggaagtaacggtcagctgaaccatgttgttgttccatggcagcaacactgcccatgccacggtatgacttgtacttcttaccatgatcttcaaagacttcaccaggagcttcgtcagttccggagaagacgcttccgagcatcacggcactaccaccggcagctaatgccttcacgatgtcgcctgaatactggattccgccatcagcgatgattgccttgccccatttgcgggcaacactggctgcatcgtagacagctgtaatttgaggaacgccaacgccggcaacaacccgagtcgtacagatcgagccggggccaattccaactttgacaacgtcaacgccggcttggaaaagggcttcggttccggcggcagtggcaacgttgccggcaattaaagtggtgtgaggatagtggtcacgaatttcggcaatcttacgaagaactccggctgaatggccatgggcggtatcgatcacgatcgcatcggcaccggcttttagtaaagcggatgcccggtcaaaagtatcggatgaaaccccaacagcggcggcaaccaacaacgcatcgttgtcgtctaccgcagctttaggtgtgtcggcagtcttcttaactgccttcaccttggcaatctcagcggcttgatcttcaatactcaaattcttatgaaccacacccatgccaccaagcttggctaacgcaatcgccatcttcgattcggtaacagtgtccattccggcacttagaaaaggaacattcaactttaagttgtctgccaattgtactgataaatccacatcatttggtaaaacatcgctcgctgcaggaatcaacagcacatcatcaaacgtcaaaccttttttaccgaatttttcatcccaactaaccatctatctcgctccttttaaatgttgattgcttaataacttatcattttcattttagttattcaacgtctctgaaagaattctcatacgcttctcataaaaatgatgaggcccttaagcaaatcgttttctgaaattgtattgattatacacgactcttccgaataaataaagaccatcgttcatcttttttcgtcgtctggcatttatttcaaatatttacattttattgttcgtgtttggagcatggacaaaaaatggcttgatcaaatgacaaatcatctgaccaaaccatatcgttaaatgcattattagttttagaatacaccaccggtaatgttgaatcggcgtctgacgaagaaggctgccactcctgacaacacacccaacacgatgtagacgattggattcaagactgggttcaaaactggcggtagaattgatgacagcgtgaagattcccatccacacgatcaggaacaagacgaccaggatgatgcgaatccaaattgagaaacgatgcttaacacctggtgtgaacatcatcgtcacaattggaatgcccaagccggcaactgccgcactaatgagaattccagtgatgcccatcattggtgagtgttggccgccctttgttggcaggaaccacagaaccccatacatcaagaagaagatcgtcaaaaacaggacagcattgtacccggcgttcttccaatagtctctgcgtggatcagctggccttgccggtggatgaaccgtcgtttcaatcttttgatcgacagtcccccacatatttctggcagttttgcctgacttctggccctccagcaattcctgaaccattgtctggacggcttcgttcttcttgtctgcagacagtttggtggcgccaagtgcctggttaaacttgaacatgtactcagcattccgcttggttaacccaatgttatcgaactgggaatggacaattttggccgcatgatcccgatcctgatgcacctgggcattcttctgacgcgctttgctgttggcattgcgctgtgtgtcatcgttgctactcactagcttcactccttaaaataacgtctaaacgttaaacctaaattcaacaatatcgccatcttgcatgacgtaatcttttccttcaagacgcagtttacctgcttccttgactgctgctggtgtctccaatttgtccaaatcatcaaaggccatgacttcggcacggatgaagccccgctcaaagtctgaatggatgatcccggcagcttgaggggccttggtacccttcttaaaggtccaggcacgggtttccttaccacctgcagtgaagaaggtctgcaggcccaaaagcttgtatgaggctctgataagccggtttaaaccgggctccttaactccttcagcctccagaaattcagccttttcgtcgtcatccaattgggcaatttcttcttcgggaccggcagcgaccgcaattgcttcggcaccctctttggcagcgaattccctgatttctgggaaatacttggagttctccgggtcagccatgtcgtcttcagcgatattggcaacgtagagaaccggtttgctggtcaacaagaatagacccttaacaatcttttgctcgtcgtcatcaaagtcgattgaacgaaccgaaccgccgtcttccaaaaccggcttgattttttcaagaacggccaattccgctttggcttccttgtcattacccttggcagcgcgttgaaccttccctaaccgcttgttgacggagtccaggtcggcaatgcccaattccaaattaatggtgtcgatatcgtccagtggatcaaccttgccggaaaccgtggtaatgttgtcatcgtcaaatgcacggacaacgtggacaatcgcatcaacttgacggatattttccaagaacttgttaccaagtccttcacctttgctggcacccttaacgataccggcaatgtcggtaaattcgaaggtggtcggaaccactttcttggctggaattaattcttgaattcggtcaaggcgcttgtcggggacttcaaccatcccgacgttggggtcgatggtggcaaatgggtagttggccatttccgctccggccttggtaatcgcattgaacaaagtcgacttgccgacgtttggtaagccgacgattcctgctgttaaagacataacttaaacgcttctttctggtttatttttcagctttttcaaggatcttttttaatttgtgatcaaattctcttcggggcatcatcacaatgtggccgcagccggtacattggattttgatatccgcacccattcgaatgatctgccagcggttggtgccgcatggatgaggctttttcatttcaactaaatcgtttaaatcatacataaatgaagtctcctttcggcaacgtgactagtccaaatcgaccccaaacatttccaggatccggttaagatcgtcagttgaggtatactcaatttcaatcttacctttacccttcttgcgtgatgaattgacaatcgaaaccgatgtgccaaatttttcttggagttgaccttctgacgccctgacaaatggtgattttctgggggcctttttctttttagccggcttgttgccgttaatcttggcagcagcctgctccagttgacggacagttaatgattcattgactgacttgcgagccaatttgatgagttcctgcttgttgttaaccgaaagcagggttctggcctggcccattgagagtttcttgtcttcgagcattttcttaacttcggtcggcaggcccagaattcttaagtagttggcaatgtatggccggctcttgcccaatcgtgcagcaacctgtgcctgggtcaggtccagtcgactcattaacatgttgtaggcttccgcttcttcaagcgtggtcaaatcctctcgctgcaggttttccatcacagcgatttccatcatctgctcttcattgacactgcggatgatggccggaatcgtctcctgcttggcaattttggatgcccgcagtcgacgttcaccagttaataattcaaatgagtcaacttccggatcgggctgcctgacaatgattggctggaagacaccggagttcttaattgaaagggccagatcttccaacgctttttggtcaaaacggtggcggggctggtacggattgggcttgatggtgctgactttcaggtcaacgacatcttctttactcgtatcgacattattgtcttggaacaaggcttcaatccccttgccaagaccagttagttttttcttattagccatggtttgccagcacctcttttgccagattcatatatttctcagcaccctttgactttgggtcgtaatccatgattggcagaccatagcttggtgcttccgataagcggacgtttcttggaataatggtgtcgtaaacctcatccttgaagaatttgcggacctcggtattaacctgttcgcccagattggttcgggcgtcgaacatggttaataataccccttcgatcttcaaatttggattgaaatgcttcttgaccaattgaatggtgttcaataattggctcaacccttccagggcatagtattcactctgcaccggaatgagaatcgagtcactggctgtgaaagcattgatagtaatcaaaccaagcgacggtggacaatcaatcaatacgaaatcatattggtctttgacggcatccagggcggccttcaaacgggtctctcgggccatctggggtgttaattcaatctctgcaccagacagttgaatggttgccgggacaatgtccaaaccctcatgtgaggtgtggacgattgtttctgccatcggttcttcattcaccaagacatcataaatatctttggtgatgtctgcctttgagacgccaactccactggtcgcattcccctgagcgtcggcatctaccaggaggattttcttccccagcgaagccatcccggcacccaaattgacggccgtcgtggtcttgccgacgccgcccttttggttcgcaagcgcgattacgtatgtcatctttcatccctcctcatcgtttgatttgatccaggggctcacggttgggtgtccctggctttcgtggatatttcttaggtgtctccttgaccttatcaatcacaataacgtgccgttcttcatcagaaactggcagtgaaaattcaaagtcccccgagactttgccgccaagcagttgaatcgctggctgagcatccgacagttccccttcagccttggcagcctttaaggcaaccattttgccgccgactttagccaatggcaggcaaagttcactcaagacggttaatctggccacggcacgggcggtcactagatcgtactgctcacgatgctcagatcttttaccgccgaattcttcggcgcgggcatgaaacagctcaacgccggtcaaattcaattctttgaccaaggttgtcaaaaagttaatccgcttattcaatgaatcaacgatcgtcactttgagttgtgggaaaagaatttttaacggtaatgatggaaatccggcccccgctcccacatcacaaatcgacaatggcgctgttttaatctgtgaaacaaaaaaggctggtgtaatcgaatcgtagaaatgtttgagatacacttcaggcttttctgtaattgaggtcagattaacgtgttcgttaacggccactaacagcttaaaataggcatcgaactgatccatctgctggtcagtgacttcgatacctttatccaaaagcgcctttttgaattgatcattgttcatgcttgatttctcctgatgtgtgaaacaatctgtttcacgtcttattatactttaccttaaaatagcttgactgacaaggtgtccaaagacatttgtcggttgcatacatataagattttaacatgttttgccatgaatttattgagtttagtaaattcacctgtaaatcaaggttattgaagttgtcaacctgatcaatccgcaaataaaaacaaccagtcggattgactggttgctgatgtctggtgttaatttaatttaactgggctctcgtcgcggtgcccatattcgcggacgtgttcctgaacaatctcgctgaccacctgagccgtcttggtcatcgcttcggtactgacatattcataagggccatgaaaattgtcaccaccgttaaataagttgggcgttggaatgccttttgcggtaatcgcattaccgtcagtgccgcctctaaacggtgtaatgctgggcgttattcccagctgatgatagacgttcaatgccagattgacgatgtatggatgctgtttgaccgtatcgccaatgttttgatactgttcattaatcttcagactgactcttggagaatcatattgatcattaattcggtcgacaatctgatgtaacagtgccaaattacgacggtatttctgcgtatcaaactcgcgaataatgagattgagatgggcctcccccactgttgcagtcatgtcggtgaccaaaatgaagccttggtgatcgcgacttttttcaggaacctcgtcttttggcaatgcactcataatttcattggccaaggtaacggcattgaccatcaaaccataagcatccccgggatgaaccgcggtgccgcggatatcaattttggcctcggaagcattaaaggtctcagcttcgatttgtccgggctggccgttatccaaggtataggcaaattcagtcccaaattctttggcagggaaccgtttagcgccacggccaatttcttcatcggggccaaaggcgacttttacatctccatgctcaacgtcaggatgggttagaaaatatttgagagcgccaaagattgctgcaactccggccttgtcatctgcgccaagcaaggtggtgccatcagtcgtgatgacccgctggccaacatagtgcttaagcagtggaaattctttcgggctcaacaccatctgcttctcggcgttcaagacaatctcgccgccgtcatagtttggatgaacctgaggttgaatgttttcggcattataatcggcggtatccaagtgggcaataaatccaatcgcactcaaatccttatcagaattactcggcaagctcccaatcacataggaattttcaggttcgtacttggcatccgcgatccccaaatcgtgaagatctttttcaaccattttcgcgagtttgacctggccgacagtggttggcactgtgtgactgttcgcatcggatctcgtgttgactttggcatatttgatgaatagttcctcgattaatttagaatcataatcagttatttcgctcaatgatttcacctactttgcaatgtatgttggattatgagaaaacaaaaagcgccccttagcccaactacggactaagggacgctcctgcgcgttaccaccctatcttcgtgtatctaaaatacacctcgacggtaccatttaaaatcgatatccggcaaaataacgtttgctgacggatcaccggcttctaccggtcacctgctcggagctcatcttcatcatcttgacaatcaagcctctcaccaaatggctcttctctttagatcgcctcgatcactactcttctcgtcatcgcattgttctcatgtgtttttaatgttagattcattatgccaatcaactgggaaagtgtcaagacgtagggtgcagaaaaactattacagccgtccaacaaaaaaacagccagaaaaaatatctgactgcctagaaaatttacttattaatcttagaaacttcatccaagaaccacttgttaaaggccccagcgtcaatatccacacaaacattagcgttggtcttgccatcatggtaagcaccacggatatcgccgacagtttcgccaatggctggaccgtcagtgacaatgtcgatccacatcttcttggtggtaattgcttctggatgaagcaggtagaagatggtgttgacgtcgtgcatggcaattccttcagcgctgttatcaccatcatgaatgatgatgtcatgcagcatcttaccggtttcgttcatgtgctcgagcttgctgagagagtccggggtgatcagggccttcatcgtaatatccaggccaaccatcgtaatcgggattccagaattatacataattcgtgcggcatccggatcggtgaagacgttaaactcggcagcagaagtcatgttgccttttccaagtgacccacccattgcgacgatccgttcgatgtggtccttcacttcaggatattcactgaacagcaaggccacgttggtataagaaccagttgggaccaaagtaatcttttcatcactgctcatgatcgtttctcttaaagcctcaacggcactaacatccaatggctttggcagatcttctgggaaatcatagcctggcatccctgattcaccgtgaatccgggcagcatcttcaaattctttaatcaacggctgtttggcaccggctgcgaccggcacctttttattgaagaagcggacaatcttttgcgcattcttagtcgtcttgtccacggtaacgttgccggcaacactggtaatcaacttcaggtcaatctcgggatcgttcaacgccatggttaaagcggcagcatcgtcaattccgggatcggtatccataataattttgatggtcatgataagttcctttccaaacaatatttgttaatatcaaacgcttacaattagttcctaacaagaagcgaacctgaagtccgcccgcttgttacttctataatagtgcactgagcaccaaatcacacaagaataaaaatcctaagacataagtcgcgacagtcagctcgtgttgcctgccagcggcaatttttaaaattgggtaagcgacaaatccaaacgccaaaccagtcgaaatgctactggtaaatggaatcaagaccacgatgagaaatgccgggaaccaatcggaaaaatcaaacatattaatgcggctgagctgattcatcatcaacgcaccggtaatgataatcacgggtgcgatcgctgcttggggcacaaatgccagcaacggaataaagaacaacgaaaccgcaaacatcaatccggcaacaatcgaggttaagccggtccgaccgccactttcaattgccgaagcgctttcggctgcagcaaccgtgggactggtcccaagaatcccggaaagaaagctggtcacggaactggcttgaaacgccttcttaaacttaccaggatttggcataatcccttccagtagccccatcgattcaaataccaagatcatggtcatcgaaaagactgccagcacaaatggaatggttaacgcgttgtcaaaatttcctttggccacaatccccgagtaacgagtgatatcgccaatttcaactgacggtgagacttgatctttgatgccaaacagaattccgaccaccgaggtgaccagaataccgataaagaagccgccggtaacattgcggacgaacaggaatagcgtgagcagtaacccaaacaacgccagcagcgtcgccggcttggtcaaatcgcccagagccagaatcgagttcttcccctgctgaatcaattgcgctttttccagtccaatttcaactaagaacagcccaatgccggcggtaatccccgctttcaaagtctctggaattcccttcgccaaaatctcactcaacttcgtaaatgcgataatcacataaatgatactggagacaatcgagattgccagcgcttcttgccaggacagacccatggcaacgacaacggtataagtgaagaaggcattgacgcccattcccggcgtcaaaattaccggtgcattggcccaaaagcccataatcaagcagccgatcaacgaagaaatgatcgttgcaaagacactcaaatcagtgggaatcccggcatcttttaagatcattggattgacaatgatgatgtatgaaatcgcgaaaaagccggtgatcccagcaatgatttcccgtttgacggtggctttatcccgtatagcctcacgaagaggcagccggttagccgcctcttcttctctttgtaacttatccaaacataaaacctaactttctagaactgattttaccaaacaaacagaccaacaattccagcagacattaaggataccagaatacctgaaagcaacatggtaccaacgtttttactgatcaaatcgttcttttccttatcaaccaagcccttgaaggcaccgataatcatacccgtagttgagaagttggcgaatgaagtgatgaagaccgttaattgtgcttggtagtgagctgggaagatgctgaggttgtgaatggtgctggcaatcttacccataacaacgaattcgttggtaaccaacttcatccccatgaattgggcgaactggaatgcctgactgacatccagacccattaaccatgcaaatgggaacatgatgattcctaagatatgttccaaagacaaccatgggttgaacaaagccaaaatcttgtcaatcaaagcagccaaggcaacaaaggcgataacgttggcagcgatgatcaagatcaaacgaccggcacccaagattgagtcgcctaagaatgagaagtatggttcacgtttaccattagcttgaacgtcgccggcttcaacagcggcttcactggaacctgagccacccattttagcaaccgtatcttcttcaggagtgactttaacagggttcaataagctggtaataatcaaggcgtttaacacattcagtggaacggcagtcaaaacgaattggccaggaaccatttgggtatatgccccgatgattgaagcggtgacacatgacattgacatcagtgccaaagtcaagttacgctttgctgacatttgttttaattggagtgatgaaacagcaagtgcttcagtgttacctaagaacatcatttcaacagcgaagaatgattcgaactttggagcgccggtaacaaatgaaagtccacggccgacccacttgatgatccacggcaatacgccaatatatgtaagcgtatcaaacaatggaacaatcatcaggattggcagtaacgcactcgtgacaaagttcattgacttggcagttccgccaaattgtggggtaacccagttaggcagggcgaagttgatcccttggtaagcgacttggaccaaccagttaaatccgtcggcagcggctttaaccgcatcacggccccaggagaaactagtcaatatccatgccagaaccaggttaattactaaaacaacaccaactgaacgccagttgataccttttttgttatttgaaaacaagaaagcaattccaaggtatacggcgacacccagaatattgaccagtaaatatgataattgcatattctgaaatcctcttttctgaattttaacgacaataattgctaaacaacgatgaagatggctagctatccccctctgtaatggaattggttttatgaattaaaccctaaataatgcggcgacttatttcaattcgccgagaaaactgctgccagtggattcattggacacttcaaggccgaatatctccccgattgaggccccaatgtctgcaagtgtccgccgaattcccaaggccttgccctctggaagtgaggacgtgtaggcaatcaacggcaggtattcgcgcgttggtgtaacgtccatggccggatcgttggcatacgaagacgtgataattaaaaggtcggtgctgtatagttcccgcatcaaccgtgccaaatgctgatccaccaatttaagtgaatcgatgcagcctttgcggttccccgtttgtgcgtgttcggacaaccctaatgcccgaaaataaagcaggccgttattcggcgcaatcacctgctggtgaagctgctccaagccaccctcatccgtattgaccggaatgacttccgcttggttctgattggaaaggtagctctggtaattgctgatcaagattgagtggacccctaaaaggccgacgatgccgtcaatgacactggttgttcgggtgggtgtctggaaatcaaacatctcccgcagaccacttaattgagaattctcccggctctggcttctaatcttgccaaaaaagccgatcggttcctcaactggcggcagaccgacaaccgggtcgctgtagcgaatgttgcccaaccccagtcgacttaatgtcggcagttgaaagtcagttccttcaagagttgcgatgtgacctaaagtatcggcgccaaccgattcaaatcgattagcgtcgctggcctcgccgacacccaatgatgccagatcaagtacaatgacacgacgaaagttcatgagaaacttcctttccaaatcaaaactttgctcagaaaaaaatattccatgtgaatagaatacctcattgcagaaagtcctgtaaatagaaatcaagaaatggcgttaagtaataccttttactttcttgattgcgctttcattatatcaaagtgttttgctggcgtaaatagggaattttcgagcgtgggggatttatggaatttgtttggttttgggttggtgccggggtggctggtggtggtgcttgttggtggtctttcttggtggtctttcttttatgtattggttattttgtggttcccttttctctagtggaaatgtgctccctggggcagcaacctgcatctaaggaacttcaaacgaaaatcaaactcgatttccgttcgaagcaccttagactccggttactaaccgccccagtccgcactcttattgaaacgtgctccgagcaactgatgctaacgtgtaaggtcaaaatgatttaaatccaaacccaggattttaatcattttgaccttacacaccgcatcacccgttgctcgtcgcactctacaaaaaaataggattcaaactcgcatctaagtactgcaagcttaaatcctatacggaagggaactttggggttaatacccacttcattaaaactttaatgtcttatcgcctcaatctaactatttgttgatccaactgccgcaaactttaatcattttcacgtttttactttattgataaatttgccgtgtggtcaacattttggttctacgtgaaactatcatacttggtgcaactgctagatacgtgatacataaacctaaggtgcgtggtacttaaaacctgtgaaccttaacctatttcattggatctttcatcaacttgatatcacatcaatttgatattcgaatgaatctctcagattcactacaagtgacctctgtacataacccttttcaattactccaccaggttttcaatagcgaatcatcgaattcatatttgaacatgtgtgactcataacattatattcaaacacttaatcacctgaattaaccttctgttattttaaactgtaacaatttgaaactctatgaatctctgaaacaatcggctaaataaaacatcatttattcaaacatccatgcttctgtgaatcgtgaacctcaaactcttaaaacttaaaataaacaactatgcgttctacatgtgaaacatttgaaaataatcctgtgacataacaacatattaatcttggatcgaagaacattcaaagtaggctgaaacccctatgcttcgaacttcttttcccttccttgactatataatatcatatctgtaagcgtttgcaagtattaaatactcttttttgaatttatttctaaacgttagattgacgcgcctttagacagcaaaaagcacggccgacaaacccgaccgtgcttcgtccatttatttaaagagaaatctaagcgggtcaaacgcaataaacgtaatgcctgctaccccaataatcgccaaggttgccatgactggcagagtctctgaaacaccggttgaatcatgctcggtgtatttcacgtgcttgacaggcgtggtcaaggtgactttatggccagaggtcgtcgtgaccgtcccaggcttctgagctgtcttcaatacgtgacggtaaattttgtccgagaaagcattgaaggtcaacagcttagtcttgttattggcaatcgcggttgcttccttaactgccttgggatcgctcttcgtcactttgtcggcaaatgtatccccaacgatgtcgttgtgaacattttggctctcaataatcggttgatccggcacaaccagtgtctctggcgcctggtcggatttggatgcatcctgggtcagcgattccaagaccgttggactgtcatccggggcatcggcgtcactggcagccgttgttggttgagcatctgtgctggatttatccgcatcagcgtccgccttggcagaggctggcttcacaaccttgctcgagtcagtatcctcagtcacgtccgccgtgtcagtatcggtgtcaatggcatcatcggttgagctggacgaatcactggtggcattctggtcagatgaactatccttttgagcagatgaatcctgagacacatcagtggaggtgtcacttgcagccgttgaagagtcacccttagcagcatccttatcactatcgctattggccttaacctggttatccttggcatccccatatgtagttgtgacgctactgccagaatccttgttcacttttgaatcgtcaatctttgccgctgcgctgtcgcttgactcatccgccgaaacgttggatgaggtcccctcagccggattcaccgtgaccgatgaatcggctttgctgaccgattgaatctgaggcgcagccgtggttgaatcatcagtggcggcattgacttgagtattcatccccaaaccgccaaaaaccatcaatgaaaataacagtgttaacctgcattttactttgatattcatttattgactcccccgcttgcattctagtcaaatcgttctattagtatcttgctaaaagtaatcacaattgatttactaaaaataagcaagttgtgcacgaactcttcatttgagtgtaagcggcatgtaagggtttcgtaacaatatcatgctaaagtaatacatagttcaaaattatgaggagataattgatatgaataaacgtttttacataacgactgccatcacagccgctttggggattgcggcgatcatggcacctggcagtgctgccacaacgacaccaacgaccccgacttcgacgagttcatcaagcaccaaatccaaatcaactaatgacaccactaaaaaaacgattccagctgcttccattgtttctaccgaagactacgaccaaccacttccctaccatttaaagggcggctacgtctacacgacttccggtttgaacaagactttgggatctgctaaagactttgccaaggtaacctggtacacttataaaaaagctgtcatcgaccgatccgcccagggcaagggcaactccgtttggtattacgtgaagagtggttccggcaagcaaaacggctgggtctggcgcggcaacttacaagatatttcggaaggaacgtttgacatcgcaatgaaaaatagtgactacttcaaatcagacacgcttatcaccatgggcgactccattaccgccggttatgacggctacgagaccttggatgccggctacccgacctggctggcccgttacctgaatgtgaaagttgataacgccgcatacaacggtgccttcttgtgtgacgccggcgatatgtcgacaccgggggacttaaccaccacggttgaggataccaattttgccaaatacaacgtggccaccatcgcttatgggaccaacgattacggtcataccgattcgaccattgaccaaattaagaacaccttggataccaatattaagaagatgaaagctgaaaataagaacctgatcatctatggcatcctgccaatcacccgttatgacaacaaccagaactccgatgacgttgtcggccaaggcggctacaccatgaacgaattgagaagtgccgaagctgaagtctatcagcaaaatgacgtgccatacctcaactggcaggacgtcgatcctaatttgatcactgacgctaatcacattgaccgatttaacgacggccgcttgcatccggctgccaagacgtatcagttaatggccagagacatcgctaactttatgattgataatttcccaaaggatcagattaagaagaccacttctactaagaagacgaccaccagcaagaccactgctacgaagaaaacaacttctactaacacagctgctgattactaaaactacgaaaaatgtctgaaacatgaatgttaatttatgtttcaggcattttttgtattcagcccatgaaagcatcttcttgtccattaatcgagagccaccaaactagtatctcttggggaaaattgatatcataagaacaaatacgaggagggatacaatgacagttttaaatacgccactcatatctgtttccgaattgaaaaagtcaccaactaaagctttccaacgagcaaaattgaatcaaaccggtgtgtttgttatcaaacatgaccaaatgctcggggttcttttgtcattgagagattacgacaaaataatgaaggaaatcgacgaactgcgctggaaagtttacaacgccggcatcgagcacaaaatgaataataacgttccctacttatatacagattacgagtttttgggtccaacggctgaccccaatccgtttttccataacgactaacctttggaggaaagtaacgaattagaagaactccaccgatcgttggaaaattccaaatcgaacgcagaatcaattggccccttaactgtatccagacaaaaaaccagcgacccgaagtaaatcggatcgctggtttattttcaaattgcctggaagaaatatgcttgaagtatcccttccgcccagcaatttattcgttacctgtgtgcaactacaaatcatattgacggaacggtgattccataaagcggacggccaaatcactttggtcgacattacatattaagtttgtagagctggaatgggtaaaactatgaatcgatgatatcttattttgcaataaaatcagtattagtatttaaatcagttctaactggatcaggtgtacggttagtagaataacgatcaaataccaaatttactgaagatccgttttgcaattgagatgcattggctttagcggtttcagttggattgtatacgtagaagtagtaaacagggattgctgttgtgcttctgttaggatccttttgaccatagaatcctgtgacatctccgaatgtttcttgaccgttagaattccagatatcactatgaagtctttgaactgtttgcacagtattggactttgtcgaatcgttgatatccttagtgaattggctgttggagtcgaaatattttgcgacagtgaacataccattaggagtaccaacaggtggtaatgactcattttgtgcactggtggtcaaatcaggataaccataaaggaaatcacttgcagttaatgattggtttacagtcccattagtaccaggcatttgcaacttaaccttagttgctgatgaaactggagttacatcaacagtcaaagtagcaccaaaggtagcacttgagagtgcaggtgtaacaacaacgttactaccgtcgcccttgagatcaccactagttgtattgagcttgtaaccagaaggtgcgccagtagcagcaatgaatgttccaaggttttgtgccttagcatttaccaaagcgccaacactgttaccttgcttggtaccagttgaagctgttgtccaagtattggtgtttgaaagtgtcttaccagttgaaacatcacgataagcaatcttcacactggtatcagcattaaagttctcagctggtgtagcaggagtagcttgcttcaaaccactgtaaagaatccaaccattagctttgctgttggcagcgtcagttgcttcgatcttaacccaaaggtcgccttcacgggtccgagttgtttgatcggtaaccttgaaagtagcgtccttataaggtgttgagtcggtaattacccggcccttcttgtattgagtccatgctgggtaagtataagttacttcagtaccatcgtttgaagtaccagggttggcaatcttataggttgcagccttttgagtagcactcaaaccagttgtttggccttgagtgttaattgaggcacttgagttcactgatgaactggtatcagttgatgcttgtggatcagtggttgtgttgtattgcgcaacaccaccgccaaatgcaccagttgatttgccgccgtagatccagccacggtaagcaccatcaaatgagacaaccttgtaatagacggaaccacggttggtggtagcgacacggtaagcacgaacgttgtgttgtgagctctttgagttagcgaagctgcttaaaacagccttgctggctttcactcgggcaccacgtaaagtaccagccttggtatataatgcactcttaccggtaaagttaacgttacgagtagtagcgtcacccccaagagctttgttagaagttactttcgcatatgatttggcacttgctgaagttgcgttagcagtcccaacagctgcgacaagtcctaatgcagcaacccccacgaagagactttttcaaagtatttttcaaatgacattcctccaatatgttaagaattaagcaaaggctagtcgattgaacctaaaaaattctggttcattaagtccaacgaccacctaacctcttcaagtatatcatcttttgaaaggccacccaaagatttaggacaaaaataaacgacccgacagaatcggatcgtttatctcagaaccttttatgaagaaatgagcttgaggcatcccttcactccggcttgaaccacaaatttccgtggcgcaaactttaccatattatattgaaaagaattgttcacacaaaaggagggcagacgagtcgcatcgtctaaatccccccttttggactagtttgaagaatgcagttttaatgatccatacgatgttggcgtatgtctcttattggaagtgacgcaatgaacttattttgaaacgtagtctgtgttggcgttcaaatcagagttgagtgcgtttggtgtcgtgttggttgaatacttatcgaacaccagggtaaccgctgatccattagccaaggttgatgcgttggctgccagggtcttggttgggttgtagacatagaagtagtgtgctggagctgaagccgtggacttgcttgagtcagtttgaccaaagaagccggttaagccagtcgtggctacttcattaccgttcacatcccaaatatcactgttgcggtaaatggtttggacactgttggatgaactagtgctgttcaatgccttggtgaacttaccattcgtgccgaagtaatcggcaacggtgaaggttccattagtagcaccaccagctggtaaagcatctgattgagctgaagcggtcagagctgggaaaccatagaggaagtcactcgatgataatgctgagttggcagtgccagttgtgccggcaacgtcaaatttaaccttagtctgtgaagcaactggagtcacatcaactgttaaagttgatccaaatttggcgctggacaaagctggggcaacggtggcgttgctgccgtctgatgcaagatctttattatcagtagtgttgatcttgtaaccagaaggggccccttcagcgtaaatgaacttgccgatggtttgacccttggcatccgtgtagttcaccgcactgttaccttccttggtaccagttgatgaagtggtccaagtgttggtggtggacaaggtcttgccggtggaaacatcacggtaggcaatcttgacactggtgtcggcgtcgaaggttgacgttggggtcgttgtagcagtcgttaaaccgctgtatttaatccaaccattggccttgctgttggctgaatcagtggcttcgatcttaacccataagtcgccttcacgagtccgtgtggtttcatcagtcaccttgaaggttgcgtccttataaggcgttgagtcagtgatgacccggcccttcttgtactgagtccatgcaggatagctgtaagttacctcggtgccatcattggtggtgccagggttagcgatcttgtaagtggcagccttttgtgcggcagtcaaagcagttgtttgactagcctgggctgaagtcgtcgagtacgaggatgctgacgacgatgagctggtgtcagttgaagccgatggatcagtggtggtgttataggcttttacaccgccgccaaaggccgttgttgacttgccgccgtaaatccagccgcgatagttgccgtcatatgaaacaatcttgtagtagacggatccccggttagtagtggcaacacggtaagcgcgccagttcttttcactgctctttgaagtcgataaattcgacaaagtgcctttggtagccactgtcttggcgcccttcaaagtacccgctttggtatacagtgcgttggtgccgttaacgttgacgttacgagtggttgcgtcagtcgttaaggctttgttcgatgtcaccttagcgtacgacttggcactcgcagaagtcgcgttagccgttccagcaactgcaacaaaacttaaagcagcaattcctgtataaatggatctttttaaatttttattcaatttccattcctccttaacaaagaatacatctagtatagcttgttataggaacagtgaaattacgctacctgaacaaatttcttaagttgtttcatgaatatgacatgaataaaacaatgcaacaaaagtgaatagatattcttaaattattcacattttaaggtctatttaagtttgtcattgtaatcaggaaatggggagccaacctttcaaaaatgttgaagagaaatcagtatgtatcgggtacacgaagggccgaagacaatttccgtttgccctcggcccctcatgtactctgttttcggccaaagtatgcttgaagtacttcagccactcgcataaaccgcttgattgaatatgcgactacaaatcatattttatatcatattggatgaaactttggaaaagtaaaggaggacggacaagcttcctcgtccgatccccctttatttacttgtagagttgtgctgtgttatgaatccgaaatggatgtgtgtttggaaagtgttatctattgattattgtgcgatgtaatcagtgtttgccttagcatccttagttgcttcattaggttgtggcaagttggttacataacgttggagaacaaccttaacagttgcgccctttgattgtgatgcagcattgttagcaagagtatcagcggagttaaatacgtagaagtaacgttgagtaccattgtttaatgattggccaaagaaaccaactttgtcagtgccagttgtttgagtaccagaaacatttgataacttgcctgcttttgcagttgcggcattaacggctttgtcaaattctgttacaaatttggcgttcttggtaccggcatcaccaaagaaatcattcaaattaaatgaagtatcagttgtcttgccaagtgcatttgtttgagcatccggcgtcaatgctgggtaaccaaaagcaaagtctgatgacttcaaagcagttaaagtaccactaggtgcatcttctgaatagaaggcaactttaagggcagctttagcagctggtgaaacgtcaacagtcaaagtatcaccaaacttagcagttgtgacatcaggtgtgatgttcttgttgctggcaaatgaatatccagttggtgcggttaactgattgttgatgtagtcagccaagttgtaaccaccattgttaaccaagctggcaactgagtcaccttgcttagtgttagttgaggcagtggtccaagtagcactcttgtctaacgtcttaccagtagtcgtgtcacggaagttaatcttaacactcttgttggcatcaaagtcagttgaaggagtggtatcagtggtcttagtcaaaccgctgtacttgatccagccattggccttgctgttctttgaatcggttgcttcgatcttaacccataagtcgccttcgcgagtacgagtggtttggtcagtaaccttgaaagttgcgtccttgtatggagtagagtcggtgataacgcggcccttcttgtattgcgtccatgcagggtaagtgtaagttacttgagtaccatcgtttgaagtaccaacactggcaatcttgtaagtagcagctttttgatcagcagttaaaccattggtttggttgctggtgctggttgaagttgctgaagatgctgatgaagctgaagaagttgtgtcagtagttgctgcaggatcagtggtagtgctgtatgattcaacaccaccgccaaatgcagttgctgacttgccgccgtatacccagccacggtattggccgtcaaacgaaacgaccttgtagtaaactgagccgcgattagtggttgcaacacggtatgcgcgaacattgtgttgtgagctcttgctgtcagcgaaagttcctaatgtagtcttacctgcgacaacttttgcgcctttaacagtgccggctttagtgtataaagctgcgtcaccggtaaagttgacgttacgagttgttgcatcgccagataatgccttgttagaggttaccttggcgtatgttttagcacttgcttgtgtggcattggcagttccggcaacggccacgaagcctaaagcagcaatccccacaaaaagtgattttttcaaattgttcttcaaattccattcctccaattgtgtaacagatagtcatctagtttgagcgcgctaaacaagaagtgaaacaaaattactaaacttggcaaaaacgtttaattgcccagtaatttttcactgctagaagaatatcacagatatgaagaaaaatgtatatttgagcgaaaccttcacagaaaagtcacatttatacggacaaatgaaaacgcctcgccacagtgtttacgtggggtaaggcgtattacttgatgaaaattggtacttttaaatgtgtatattgtgtgtataaagtgtgaagattttgtgaagataactgtttagtaaagtaaaaagcggtgtactgataatgatttgtgcaatttcctaagcctcaggtttgtacgcgtcacatacatataaagcgccagtgggcgtcccatatgttccaccaaaaatgtcgcccatcaacaggtgtaaggtaacggtcttataagtcacattaccatcggcatcgaaacttgggtatttaggagtcgtcagcgtacttagattatcgttcaagtatgttcccaattcagccgctgaataggttgatccctttgtgccaacaaatttatccaaaacaacaccttttgacgaatattgtttgattgcggcattgtagaaatcagcatttatttgttccacggcagcttttctggctgtgccatccatgtgtttgagttggtaaaccaggctgtccttatcgctctccttttgtgcagcaacgtcaccagcgctcaattgaatttctttagactgatcaccaagcttaaaagtaacttttgccgtgccatactcgctgtctaccccagtcaacggttccatttcgcgaaaattaccatcaatggcaatttggggattgattatactgggaactgtcgtgttgacggcagtcagctgaatgttaacttggccaccaaacgttccacgagcgatgttgtcaatttggctggccgaaagcttgttatctgcaatctgatagctacttccagacaactgcgtgttaatttgagtttggatgtccgcttgatcattactgttcaagatccattgggcattattgctttgggatgtccccacagtctgtccggcaactgcggttgcagtcgtccacttgattgtcttgaaagttgtgccgtcgggcttaatcaaattgatggttaagtttttggcatcaggattgacaatcacttggttctgcgtcagtccactcatcagaatccaaccggctgcaggcgagttactgttgtttggatcataaatgtggacccactgatcgttctcacgtgttcgagtgccgacttgatcaattttgaaattggtgttggcataaggactcgaatctgtaattgctcgaccgactttgtactgcgtccatgatggtgctttataggtgacagatttgccattatttgcagttcctggagtggtgattttatatgtggcattctgctgagctgtcgttaaagctgacagtccctggttgttgaaagtcgcgtatttggtaacgccaccactaaaattacctgtactcttgccaccgtatatccaaccccggtattgaccatcaaaggtcacaaccttgtagtaaacggagcctctgttggtaaccgcaacacgataagtgcgaacgttatctctggagtccttagaactggctagacttctcaaagtagacctcgtcgcaactacccgagcgcctcttaatgtcccgaccttggtgtacaaagccttagtgccagtgaaattgacattccggctgcttaccggaatcgtcagcgtttcattgctggcaatcttcgcgtaagtcttagcactcgcactttgccccattagcgagcctccagcaacagtgaggcctaaaatggcgacactcaaaaagatagatctttttaccctcaagttcataaaattctcctcaaaattcttatttgtaacggttattattttacagtagttaagggtggtattccatctatttttaacgcttttcacaagcatttaaagtgagttaaatatacgagattcaagattattttcttcaacaaattaatgatagaataaagaatgttcactagatcacagcaattatttgaggagtgaagttatgaagaaaatcatctactgtttcctgttaacggtcatgatggtcggcggcgtcagctattcccaaccgacgacaacgtcagctgcaacgtacgtttacgtgactaaaacggggaaacactatttttatcaccggcataaccgggggctgaaccgggcaaagaaagtctatcgggtgaagctttcaactgccaggaaacggggtttaacgttagctaaaactgactacaacccacacaagcgcaaggttacccgcaagcgcgccaaccaagcgaggaaaaaggctaaaaagaccagcaacaaaccaattcgagtcagcgggaaacaaattgtgatcattaatcacaatcgaccaaagttttcccagagtaccctttcccgtcggcatggtgcttggcagcgatatggcaatcttgatttcttgaatcgggcaaccaccgccaatgccctactaaacaagaagttaatgccaaccgggcagcgcgaaccactgtacttcgatccaaccggctggcacaacaagcggatcaagggaggctggttgtataaccgttgtcacttgatcggctaccagttaactgggcaaaacaacaaccccaagaatctgattactggaaccagatcactcaacacgccatgcatgctgaaatatgaaaaccaagttgcctactatctccgcgggagttacaaacattacattcggtaccaggtaagaccagtgttcaaaggtcacgacctgcttgcccgcggtgttcaaatgcaaggtaaatcggttggcagcaaccaagttcatttcaatatttatatcaaaaatatccaagccggcgtcaaaatcaattacaaaactggcactagccgcgttggctaaaacagcttatgtatcaaaatagggcatcccattcgtggggtgtcctatttgcttgagcaaattatttcgaagacttggtttcttttggtttgtcgatgtcttgaacaaaatcaaattcatcgcggtggttcttctcccagtcttctgcagcttccaggtatgggattaggtcttcaggtcttaaatccttagccatttggtgaatatcctttagaatttcttcttcactttttaaatactttgccatatttagctcctatctgtttaccttgtcagactcatctaaatcctcatcaaagaatgtgtccttagaatcgtcccatttttcagcagcttgaagatatggaattagatcttcaggtcttaagtcctttgcagcctgatttacaatttttagtaattcatcatgactctttagatattccgccatttcaatcactccgaatgctgatcctagtaataatatccttatttcgaatacaatattcgatgccattaggaaggaaaatattcatcctatcgtaaacattagttgaagtcgcacaacagacacagtcaatttgatgaaaccaccctcgctggattgcattcttaatatagtattcaattagtgcgccatccaaagcatgctgtctaaacgtatttttaaaccgtgtgtgtagattattgataccactgtggaagaatgggtctttaagaaattcacggaaatacttcatgtcttctaaattgtcgacaaaattgagactatttccaatccgatactcaatttcgactctcataatatcatatctcgatagtgatttgtacatagacgcccaaaactcgccggctaattgtttatcctccaagaatccatacgtcccataccccaaacttccaggctgcttgaagtgactgcctgcataaaaatgtccccagtcattctgtggtatcctaaacccctctcgtaaaatcttccctgcattcgcatgcgatgtcgcatggtaaagtgttgcctcggccatgtcggcacccccaaaatcatgtctgttagtgatatcaatcataccaagtacgaacgtatgtttcaacttacaaattgattaaaaggattaaaattgggagaaaaagtgttttagtgtgtcgttaattaatatcaaaatagagcaaagcctaaagtggctttactctacttataccttggatatcagtcgttaggatggctgatcatactggtaatatgctttaactggagttccatatgttccatcgtccgccttataagactggaatgtatactggacccacttatcagcattctgtactggagtttgagaatggtccccatccggagaaaatactggaatcttgacagatttcaacgtgttaagcgctgaatggttcacatattcaaaggcagtctcgccagtaaatttggcgccaggatttccactaaattcgtcaaagttaagaccggtcgaaataaattgtgtcttagcttgatctaaataagtttcagtaatcccgttatatgcagctagtcgaacattgtcatccttaataccacttaagaagttagtcagcaagtcagttccgtccttatcagccaactgagctgccgtaacattgaaagttctgttggtaggagttgccgcaccattcgctgttggattgtcaacaaatttatcatttccaacgtcacttggaatggaatatccatttggcgtagtactgtataatccggacactccctttaaggcctgagcagtgttatcatttgcgtccttctgttttccatatggattgattgtactaattccatttgaaatcggcaccacattcagataaacctgcccaccatattgtccgcgggcaatggtatcaatctggctatcgctcagtgtatttccaccggaaagttgataacctgagttattcaaggctgtgttgatctgtccctgaattgtttgtttgtcactatcacttaaagtccagttggtactgccactcacggctgaaccaacggtactccccttagtcgccccgcctttaacaaaatcaattgtcttcagcgaagtgccatccggtttgcggaaattaattctcagcgcgttgtcagcaatgttggtcaccgcgttcaccgagatgttcactgagctaccaaaattggtttgcgcaatctgggcaatctgagccgtcgtcaacgtatccagtgtgtagctcgtcccgttcaaagcatcccgaatctggttcaagaggctggcacggtcggacatgctgatggtccagttgccgttatcgttgtacccaaagttggtccccttcttggcgccgtcccgagtcaccgtgattgatttgatcaccttgttgttattgttagggtcaaccaaattaatctggattgcgttgtcggcaatcggtgcttcggcctgcttcaagccgctgtacagaatccagccattcgcaggtgaattggcgttcccggtatcagtgatgtgcacccactggtcgccttcacgagttctggttccgacttggtcaatcttgaaagtgttgttggcatacggcgatgaatcggtaatcgcccggccaaccttgtattgtgtccatgccggctgcttgtaagtcaccgtcttgccatcgttagcggttcccggactggcaatcttgtaagtggctttctgctgggtgtcagtcaggctggacaggttttgatttttaaacgtgtcaaacgaggtcacgccgccaccaaagacggattgaactttcctaccgtaaatccaaccacggtaggcgccatcataggtaactaccttgtagtaaaccgatccacggttggtggtcgccacccggtatgcccggatgttgttctgcgagttcttggagttagccagcttgcgaaccgtggtcgttgaagccaccttcttggcacctcgcagcgtacctgccttggtgtataaggcgtttgagccggtaaagttaacgttccgactggttggggcgctggtcatcttctggttggaagtcacccgagcatagcttttggcgtttgcggattgggcggttgccgtccccgcggctgcaataaatcctaaagcagccaatgacacgaataaagatttcttgagattagacgtcataaaagtactcctcctttacaaaacttaacatttatctactccttaggtacattttcattataaaggaggtatgttttgggaggcaattttgcggtctggagaatatgacaatgaaattaatccaaataacaaaaaaagcaagtccctttaaaggcaacttgcttctcgcatcaaaatacatattttacttagttggagcggtaacgtgtggtaactgagtaacagcagaaggatcataaacagctttagctgggttaccaaaggtgccggttaatcccatgagtccagtatgaacactgtcaaacgaataggatatatttgttgttgtagaatcgggaacatggttttgtgcgtccacagtgaacagtggaaaacttggtgagtgaatagtccacaaattattagcaaataatgtaccagtcaggtcagctatagtccattgctgcccgctttggcccttaaagacattgaagtctagattacttgacgtatattcattaagtgcagcatcgtaaatctgcttatttacataattgattccatcaatggcaagattgcgcttgtcagtgtcggaagcaccagctgcggcggtacctacataataatcaacaacctgctgagcaatatctcttgtaacgttgcttggaacatcattaaatggtttagtagtgtgatccagttggagcttcgttgtaacagcattcccgtttactgaattcagtgacttgctattcccatctgtataaacatacggtgtaattgtacttatagcacttgctacaggaacaacactaatataaacctgtccaccataagtcccacgagcaatcgtatccatctgagcactagtcaaagcattaccagacaactggaagttagtcccactcaaagcagaattaatctggttttgaatagaagtctaatcgcctgaatacagtgaccaaagtgtgttaccacttggctggaacccaacgttactacctttgttggcaccgctcttaacccagtcggtgtacttcaaagttgtgccgtcaggtttaacaaggttaattcgaaccgcgttgtccgcgatattagcaatcttgttcacaaccaagttggttgaactaccaaagttagtctgggcaatttgcgcaatttgtgcggtactcaagctgtcaagaccataactggtgccgttaagagcagctctgatttggttttgaatgcttgaaatatcagattgactcatcgtccagctgccgtttgagtagtaaccgaagttggtacccttttgagcgccgcttctagtgatcgtcactgacttaacgacattggagttattggttgggtcaaccaagttaatttgaatggcgttatcagcgattggcgcttgtgtcgtagccaatccgctcatcaagatccagccattggcaggtgagttagcgttgttaacgtcatagatgtgaacccattgatcgttttcacgagttcgcgtacccacttggtcaatcttgaagacgctgttggcgtaaggcgttgaatcagtaatcgcacggccaaccttgtattgtgtccaggccggtgacttgtaggtcactgtcttgccatcattggcagttcctggattggcaatcttatatgtggcgttttgctgagccgtggttaagcttgaaaggctttggttgttaaatgtggtgtagtgtgtaattcccccggcaaagtcagaatcatctttaccaccgtaaatccagccacggtattggccgttaaaggtaacgactttataataaatcgagccacggttggtaacggcaattcgataagcacgaacgttgttagtggagacattcgagttggcgatactgctcaaagtagctttggaagcaacgactcgagcacctttcaatgttccagccttggtatacaaagcattagtccccgtaaagttcacattacggttctgtggtgccattgccatcttctcgttggagacaacgtgtgcataagttttggcactggcattttgagcattaacagttcctgcagctgcgatgaaacctaatgcagccaatgataggaacaaagatctcttaagatcaaatctcatgtagaacccctccttaaataaacccaataatatctgattatctacacatctttattatatatgagtaatttagggggttcaagaaaaggccgttattgtttgatgacgttttcattacggaactgatgcactatttgtaaagttcaacctgccgatcatttaacggctgtgggtctcgattatcatcgccaaaatgttgatggaaccagtcgatttggcgatcgctaatggtaaattcaggattggtcaaaacgagccactcaactccttcagtcaacggcggtgtcgtcaacgatcctaaataatggaagcccaccggataccatggcgcccaatcgctgatgttcagatcaaccggttcggtctttccattttcataagtcgtcataatctgctggagcttttcatcgtccaattcaccggcggaaaccagcaaggccacgacgactaattggccaatgtcattttggtgtaccaagtgaatctccagtgggtagtgcttgccgtcaatcacgtgctcggatggcgcgtggaaatgaacctggacaaagtgatactcgcgattaaaaatccgtgctgccccctcaccggtcaggcggacggttgtcccatcatccacttcttgatgcaattgatagtcgctcacaacatggtagtccaacggctcttttgacttcaatgtctgagctgtcttaatttcgattggtgactgctggctgccaaaaccattcggccactttgcttgattcttgtaatctagcataatatccctccccttgggtatcgttcaccgctattttaccttatgttggggtgacaaaacagttatcgtgttggaagttgggtgtttttttgatctcactttgatttggtggtcgctcaatgactacttggtagttggattgattttagtttgtggttggtttgtttatatttggtttttgctttgatgcttcctagccgaaacctgcgaaaaaagactgattccggccgtataagaaagtccccaccagatgcttaggaacaagcatctggtggggaccttcttatactctggaatcaaagcgtcttttttctcactctgatttttaatcagtgaaagtgtagtacacattcacaggctggccaatcgtgccattgtaagcattgcttgccgtgtagttaatcgtgttccaaacaacttgaatggtattacctgaagatgccggcacaacaaattgcgggtacttcggtgattgcagagtcatcaagcttggattacttctgatgtaactcatcagttgatcgccggtaaacgttgagccatttgctgcgttaccattggtgaagttcaagttggatggtgccacatattgaccttcagcagctgacttaaacgtattgttcaagttggtcaggtatgttggcccatagttatttggatcgttagtgaaggctttagtcatcgcattcaaaatggtctgttgttgagcagatgtgaagttgttaaagtcactagctgatagataaccgccttggttaccatccacgtttggattggtatccacaaagttggcacccatgttaacaaccccattattaacagcagtcaaagcacgcgtcccatttgaaacattattactgttggttgcgtatggtgtaatcgtactgtaagccgtgttggttgcggtgctgacaacgggaatgttaaccgtgccggtgccaaattgagcagccgctaaagcagcccgctgaaccgtgttcaaattgctggattcaaggcggtaaccggtgttaaccaagttggaattcagttggttaacaatgtcgttagcagtctgatcagtcaaagtccacaggccagaggttgatgaataagtccccagcgtagttcccttgacggcattttgaaccgtgtagtcaaccgtcttgatggtcttgccgctttggtcagtcaaattaattcgaactgcgttgtcagcttgttgggttgacaccggtgttaatgaactaaatttgatccagccattggcaaccgtgttagctggggttgtcgaagtaatgtgaacccaaacatcattgctgccttcacgagttcgataaccactttggtcaatcttgaaagtggcgttggcataaggcgttgaatcagtgatcgtcttgccgactttgtattgggtatattgtggtgaatcccaggtcacagcgtcgtcgccggtacctggattagtaatcttgtaagtcgtgctggtctgctggctggttggcgtggttgacgtaaatgtcgtgtaaggcccaaccccaccggcgaagctgccagtactcttgccgccatagatccagccacggaagttctggtcaaatgaaacaactttgtagtagaccgaaccccggttggttgtggcaacccgatagactcggaagttagcggttgacacgttagcgttggctaaattagaaacggtcgccttggatgcaacgactcgcgccccgcgcaaagtaccagccttgttatacaaagcattggttccagttaaggtaacgtttcgagtcgttggatcagaattcaaaactgaattcatggtgactttcgcataagtcttggcgctggcagtctggctggttgcaacccccgctgcagataccaagcctaaagctgccattgaaacaaataatgacttctttaaattcattttcatgatgtgattcccctcctaataatctatttcttgacccacgtatattttaccgcttctcatatggtgggtgtagaatatgagcttttgaatgttagctaaagccaagcatatctttcacgtatggaactaatttcttataagtttgttctggaatctgattaacaatttttccgttccgtgaattaaggtcatagttctgcaactgccacagtgcaatatatctgcgaatattgccggcctgcttgcttgttatgaccaccgtactcccgtccagaatgtggctcggcgtcaatcacgacaacatctctttgctccggaaatctcattattcaaaccgctccttcccaacaggattaagtggttgcagttcaggattttcttctaaatccttctggtaatcatagtttttccattcaggatcgtcaaaaatatttttgtgcgtcacaggggtgaatacgacattaccgttatccaagacttgaacctcatactttgtcccaatatttgcgtccaagtctgtagggaccgtcaaaactcgactattcccagcttttcgtaatgttacaatcttactcacagtcatcgcctccatatttcttttcacgaaaagtatataccaacatattctttgcggcgatacatatgtacatacaattcgatcggctatctaaaaagcgattcaccaagaaatctttctcctggtaaatcgcctttctgttaaaaacaatgttggggcgtcactatcagctacctctcaattgtttcgaatgtttaaataattgtctacaagacttatggtattaaattaatatctgcataagcatagtatgccttggcagctttaccataggttccggcatcagcgctggtagcaacgtaagtcgtctgatcggtcacagccaagacacccggagctgagtaagcaactggatatttggttgaatgcagaacgttggcattatgaccattgagataagtcatcacactagagctggtaaaggcagttcccggaaggccggtgaagtccgcaaagttcacattggtgctgataaattctttgcgtgcttgagctttcatggcagaaatcaaactgctggtaatcgccttttgatcagtagcgtcaatattattggccacaaaccaagtttccagcaacagtggattctgagcggcttgggctgcagacatgctgtaggtcttgccgctatccggtcctttagcagatgtgactgcagttgttgaatactgaccatcaaccgccgtcaaagcacttggcgaagtcagatccaacactgcttgagcagctccggacaaactggtgaaggtgctcaagtccgcatcaattttgaatgcgtacggctggattgcgccaacttgattcttaacggcagagacgttcaagtagatttgaccgccaaattggccgtgggcgatggtgtcgatttcgccgctggtcaaggtattattgccggcgttcagctcataagtcgagccagtccccagtgccccattaattttgtcttgaatggctgcgaggtcagctgaggataatccccaagcgctgttgccgcttaattgataaccgagattgttgcctttcacaacgccggtcttggtccaatcaactgatttgtaaatcgtatcatcaggtttgacaaagttgatccgaacggcattatccgcaattggatcggctttcttaaccactaagttaaccgaactgccaaattgagtttgggcaacctgagcaagttgggcagcactcaagccttccaagccgtagttggtcccattcaatgcagttctgatttgattttgaattgtgtcttgatcattggtgctaatcgtccaggtgccgttggtattgtaaccaaagttggttcccttttgggcggctgatcgagtgacgtcaaatgatttaatgacactcgaattgttatccggatcaaccaaattaacccgaatcgcattgtcagcaaccggtgtgctgacttgagtcaagccgctcatcaagatccaaccattagcaggcgaattggcattggtgacatcggtaatgtgaacccattgatcattttcacgggtccgcgtaccggtttggtcaattttgaaaactgatttagcataaggcgttgagtcggtgattgcccggcccaccttatattgcgtccactcaggagattgataagtcacggtcttgccatcattggccgtcccaggattagcgattttatacgttgatccttgttgaacagctgacaagttttggctggcgaaagtcgtataggcggtgaccccaccattaaagctggctttgttcttgccgccgtaaatccaaccgcggtactggccgtcaaatgtgactaccttataatagacagatccgctattggtttcggccacccgataggcacgaacgttatcggttgaaacgttggcgttggctaatcggtccagtgtcgccgccgtggcaaccacgcgggcacccttgacatcagctggtttattatacagcggatagatcccggtaaagttgacattgcgactggttgaaggtgttgtcatgacgctgtttgacaccacatgatcataactcttggcactcactgcctgcatacttgctgtccccacaagtatggtaaaaccacaagccatcaaagatagctttaaagcccttccagatttcaaattcaattgcgactcctccttgaatgatcgtttaaatgtgattcgttcactagctaactagattgtatattagcattatcaaaagcacaatagaatatgaataaatatttatggagaaatttaactaaaagggcttgtaacgtaagctcaaatagtatccagtcaaaaatacttccacataaaaagaagtgcgtactacctgaatattaattcgtctcaagatatttcaaaaaagcaaaatccccgttccaatcagagctggaatggggattcataatatcagatttttattgatttgtaatagtaccagttgcagtcaaaccatccagcttgatccagccgttgacaacggtgtaggccggatcagttgcgacgatgtatacccaagtatcgccttcctgagtccgagtaccgattcggtcaagacggaatcttgcttcgccgtagttagtggtgttatccacttgacggtcgtcatggttcaatttgtattgcgtgtacattggatccatgtaagttgcgcttctaccatcgttggcaatgcctggggtggtaatgcggtagatggtgtccttttgagtttggctcaaagtgccttcagtaaaggtcgtggttggcttgatgccgccagcaaagttgctggtactcttgccaccgtatacccagccacggtattggccgtcaaaggaaactaccttgtagtaaacggatcccttgctggtaacgccgtaacgataagcccgcaagttgttctttgattgacgggcattgatgagatctttgatggtcgacttagtggcaaccacacgagcacccttcaaggttcccatcttgttatacaaagcattggtaccagtgaaaacaacgtttctatcatatgggttggtcttcaaaacacggttaaccttagtcgttggatatgacttcttcttggcattggcagttgtagtccccgctgcagcaaacaagccaagcgctgcgattgatacgaataatgatttcttaacattcaatttcatgtataatacccctccacattcatatttagtacagttatattataccgcagaaccctccttattttgttataagcagagaaacagaatattaagatcttgtaacacgcttcacataagtaagtaaacgcaggacggtgcgggatggcatgaaccacccttccgcccgattttactcttgtatctgatacaccacaagttggcatagttgatggacagggtcttaagcttctcgtctgaagtcttgaataccaattctaatttacgcatctgtgtttcctcctattagtcagtgatgattacgcttgtggtgcttgaggtgcggccggtgcttttggtgcgtcgcttaattcaacgtggtcggttgaagatacggctgcgtcagtgatgttaccgtcgatcaggctttcaaggatcttaccgaaagcggccactttttctgcagttacattttgagtaacatacgcaaaagagtgcttaacgcccttcttgtgatcctcattaaccaacgtataggtaacatttgatttcatccaatctttttgcattgtctttctcctctattctgcttaatttgtaagtcgttggcgccaacccttacactattactaacaaaatgaacccccaaaagtgttaccttttttcaaaagtttttttgaagcttgttaataacccgcttccgccaagcgtgcacgcactttcgactgacaccacattctttagcaatctctgagatattcatcccataatcataagcaagtaccaaatatttgatttcctttgggttcaactccgtcattagctgtcttgatagaatatgcgtgtcatagtagcttgcagaatttttcccatcaggcagttctgccagcggatcaacattgtcatccggcacttcaacatgctcggtgatcgtgatttgtttgtgcagataattgattagatcccaatacacgccgcgatagatgtaagccaggtatgattcaggctctttttccaggttgatggctcgaatatatttttcaacaaaggaaagcatcccttcttgaaccatgtcatcatagtaggtattttgcttggagatatgcagcttcttcagcaccccatagaccaccagctcatggtcgccgtctaataggaagtcaaatgcatcttggtacaattcgatttgcttgttgttacgtttcatcatgaatccacctttgattagattggtgatccattggccaatgtcacaagcaatgagtatagatggaaggtgatggcggaacaacgtgggagatttaggcggcttagtgcctggtaatcctgggtttgtgggatttggctgtgttcagtgctggcgacttttcgctaaaacgcaaacttttagcaacttttgcgtataatatgtattcaacgaggtgattggatgaaaatggcgacggaacaagaagcattggatttgttggcacaggttggcgtgcactatcggcgggtggaccaccctgccatttggacgatggatgatcccaatgcaccccaaggcctacctgaggtgaagaatctgctgctgaaggatcgcaagtccgatcagttctatttgtatctggtcgacaatcaccgggtcgactttaagtcgttggctgagcaactggggttgggccacagccggctgaaattcgccagcgaggaagaattggaatccctgctcggcgtcgtctccggtatggtcaccccactggcattgatgcacgacacggacgaccaggtgaaagtactgattaataagtcactggaatcgatgccggaaatctctgctcatccgaatgtcaacacggcgacgattttgatgtcttacgctgatttggtgaaggtgttggctgccatggggaaggtgccgacgatgattgaataacatcccccactgatttctgagtcatcaatcaaaaaagtctagcgccaccattcgaattcaatcgaaggtgacgctagactttttagttgcgcttaatccaagatatccgggtactcataatgaacgcctggtatctggagggtattaatcatgtcaatgcccaagtaatcgagaattccttccggcacatccggcgcgaccaagacggcagcgtttctcgaggcgatgatgcccttctccaatcggcggtctttgccgtcaacttggaagtgggtctcgtccaccgggtcgtaggaataacccagaccggatgggacggcaccggttaagacttcttcaagcgccgtgtcaggataatcctggtggtgctggataaccccaatgatttccccgtgaccccagtcaaagactgagaaggtgccgtcagggtcactgataacgttggtcaggtccggcacgatttctgctaattgtttgcgatcaattttactgtgatcttcattttgcatgtgtctcacatcccccttctttaatgattccggcaacattctcacatgatcgattacaagatgatacttgcatcccgccaccgactaaggattccttttatccttctcaaattcaaacgagtcgggaaaagaaaatgactgaatcgaaattgccggtaaataatccaacagcgatatttgtctaacaatctctttaactcgcgcagacacgacggccatgaccagttcgcgagacatttcaaaaatgtcatgctcactgctaacttcactatcctcaattaaaaaggtcatcatcaagtcaaataataccgatcgataattggtcttttcttcgtcatttaactgagtctgaactttgacggtagaggtaaagagaatgttggcgtcttcttttgaaattcgcaaatgcgtgttactcaaagaagtttgtccgacctctgaatagtctgaagggctggtcactctcttctggtccgcttcggggttaatcttatattgtagattgttaattctatagttattataacgaaatttcattcattacctccagccggtcaaagatgtcactttctcagaactactatcaaagctgacactcttagacaaagcggatacagactcattagccgcctgtgaacccagatctttaacaggaacagtaactgaatcagagagtgactgagaattgcggattacgactgttaaatccaaatcatctttttgctggtcttttgcttgatttaaccttctaataatagagtggtatgcgtgcacatcagtcgagacacccatttcaaactgcagaaaaagttgtaacgacatccccaaaacattagcggtttgtttttggtcaagctttaattcatgttcaagattcatgatttgctgggaaagctcaaaatactcagaattcaagaaattattgacacgatctgaattaaaaagttcctgaaagttttgtttacgttgtctaatctcatcgttcattattgggctcctccttccaaatgtttcctagaatatggtgcgactttccatcttctaaaaatgtcttcagagaaatgctgattttcaattttagtaataacgtccactgaatcactggctaagccattggtcaattcattcatacgaaccggatccgttaattcacttttggtaaatccaaaatgaatataataaccgccaggttggtgttcttttggatcacttagtgtaggcctagaagtaataaataagattcgtcgtttttcgtatgcagcattaatccgaatttcatagcaaggcctatcactacgattaagcaactcgataatttttgaattaaccagccgtccaaacttgtccgtaacgtatgtgctaaacaccaaatgccccttaggatccttaaccatcttttcaataatgccggtatcaacatcatatttaagctgagacatttttgttaaaatgacaatcagctgtctgaaggcatattcatcattttgaatttcacgttccacgtattgattaaaaatatattgcttgtgagatggccaatatggcaatccgatcgtaaagaagtgttccatcacttagccttccatataagtctttcatagcaaaaatataaatcttgattacattaactatgtctagaataattataacctaagataaagtgatgataaaacaaaagttggctaacttgcaatccataacctcgagtttggacgatgacaggattatatatccggtgagcaggatatagtaatataaaaccccttgaattagatttctccaattcaaggggttcagttctcgtcgctaccaagctcagcactcattgtgaccttacatattgctaattattagcattgttgaacttgttataaagcttgttgaagttgattgtgccaagtccagtagcctggttgtacagcttgcccggttggccagtgtagtacaagttgtcgttgaagtccgcgtcgtcaaggacgttaaatggactgtcggattcttgggcgtacttgtaaatctgtgggttccagaaaccgattggcgtctggcggccactattcataactgcattagcagcggccatttgtggcgcggtgaagctggttccgccatcgatccgccacagaattccgttggccttggtggccttcttagtctcagggttaaaagtgtacttcggtccggaaacaattgaagcgtaaccggtcaatggatcggcgttaccggcaacgtcaggcaggttccagccagtcttggtacctgtgatgacgtgaggattcttagtgatcgagtatttaccattcttgaaggtcaggtagttcatggctctaaaggtattaacccccggaacgccgatttgatatctcggggttgggttgatgtctgagaagccaccgccaccaccggcgaagctgctgtatttggtgtcataggcaggtctggagtaagtgtcgccccaagcccgttccttgttcacggagatcagattgccatcgataatcttttggtatggcaaagtggttccgccgacttcaacttcgtatggtgaagtggacatgatgtggttctctttggcacctgaaagtgcatatggaccacggtcgccgctggctttgaagacggtgattccttgaacggccgcctgttccaacagcaggttaaatgcgtgactgtattggctcagtgaagcacttgggtcaggccagttggatttggtttcaaaggccggcgccatactggtggtgatctgcttgtcgttgttgtctgagactgcagtcatgaagttgttgtaaaaggctgatgtcaaagtcgtcttggtgccatactgaacggctgtataaaggtcgatctgggcctctggcgcaatcgctgaagcagattgagcatccaaagtggcctccatctgagcggcactgattgacttattcaaatcagcttgagcctgagcctgggtcgccacggtgtaaatgtggtgaacccggctgatgtcgtcgttaacgccggcttgcttccagtaggtcagcatgtcggcatcccgcacgtcactatcattgataatcccgatgcgctgaccggacccttcaaggccttggtcgtacaaatcatcgacttggtaagctttggcaaatttggcagcaccgtacttcttcgagaaggcattgccggtgtacttgatgttcggcttggtgtcggtcgtcgacaaagtggtcgtgtcactgtgggtggcagacttcttagtcgtcttcttggccttggttgcggtcttggtcgtcttcttagtcttcttatttgggttcgtcgaatacaggccaatcacggcaaccaccttatcggacaactgtcccggtaatttgtaggacgtggttggatgataccccttcttcttggctggcacgtacttcgccttgaaagccttctgcaggttggtcgaagtcccggtcaatttcatcgacaggttgccaggaaacgcctgggcctggacgtgatatttggctaaataatcttgaaatgcttgtatgtaactgtctgactggccgaatttgtctgcgaaggcactcggtgtcaaatattgatgatactggctgctggttggatcaaccgtgttgtaaacgtagtcggtcagctcgttctcatcgctgggcttaaaggtcacgttgacaaccgatttcttctcggcagctttggcttgatcggcgctgattgccagcccggtacccagtaccagcaggctgcttaacgctgtgatcacaatttgctttcccctcaaatgaatcactcttttctttaatatagtatgcatttattataccaatccagtgcggtgattactggaatttagtctttgaagccacataaaaagtggtcgacaaactggattgtccgaccactggatttgaagtgctggattttaatcgacgttatgcgtccgcgtccatggtgaccttttcaacgatctcttctttttggaggtagtcctcgatgcctgccatcgcttctttttcatcatcgccattaatttcaatttcaatgtaactatcctggggaattcccagtgacatgacacccatgattgacttgagattcaccgtgcggtcgttgtacgttaacgtgacgtctgatgtatattcctgggcagccatgaccaaccgggttgccggccgcgacatgatgcccgtttctgcgagtactttgaacctacttttttccatgacatttccctctttgttaaaagtatagtaaccagttaaatttattttatagtgtaagcgttttcttactgataatcaatacttttagggtggtattgaccaattttagtaaaaagtataaagatttgagtatattttataaaccaacctggtcattttaatgatttctagcggatctcacccaacaaagtcaacgctcccagaaaattctttaacctttcgctaccaaatctttaacactatttcagcctgacatctttcgtcaatagaccacaaaattcctgtaaccttcttgaaaagttgcgggcttatgatgaccctaccaaatctaataacgaggtgtcttcattgaaattcacgaaattcattctgagctttgcggtagccggtgccatcatgggtggcgttgcgacaactgccagcgcagatacttataacaacaccaacgcaacttacaatcaacaagccagcaccaactattacaatccaaatgccggcacacccaaggcaacggtcaacagcaacgattcaagagccgatgccgtggttagcctggctaagcagctggcaacccagaacatcccctacgtctggggcggcgaatcgctccaaggcatggactgctccggtttgaccgactacgtctaccaaaaagcagccggcatcagcctcggccactacaccgtgactcaggaaagccacgttaccaaagaagctgtctctgaagcacaaccgggcgacctgttattctggggtgatgaaggtgccacgcatcacgttgccatctatatcggcaataaccaatttgtggccgcaccgcaaccaggacagaacgtcgatgttgagacgatcagtagtgcgtttatgccaagtttcgctgggcatgtgaacggatagtgtgcgtagtaaattggttagactttgagcattagtcaaataccttttcggccttatgcattccgagccaacttaatagcacaaagaccagctaaaaatgagctgtacctccaattaccattaggagatacagctcatttttatgttttaaaggttttgcgaagaatcatttcagcacattaagattgcccgtttcaatcaagataagcactaattcatcgctatcgatttgataaaccacgacccacttatcaagttgactactcgcctttccaatgcgtgcaggatgaaactcacgatacccacgccattgcccaaccaatggatgatcgtgaattttgatcaaagtgtcgtgatctttattaagaattgcacggagacagtcctcaatcaactcaacaggataatgcttctttttcaatcgtttcaaacttcgtacatattgtccagttgccttaatttgaagttgagttataatttgtccgaccaccgtttgtaatcttcaacacttccaatgttgagggtctgaccgtgttcagcttcaaacttcgcttgcattgcttctggggagttcaatagatcgctcacaccatcttctgcggctgagatcaatgccaatcgaagatattccgagactgtaattccgacattggctaaattttgttttgccttttctgctattttttcgttgactcgggtagaaattgtcttattcttcatatccactgccaatgaaatcacctcttttgattgtgtaatacctgcgtcttacaataattatattcgattcacacatatcgtcaagcaatttatctgcttcattacaacgtcactccgcctttaccacctaatgcatttttcttccagtcatcccaagtaatcagtttataagccgcgtcccagaaataccactccaaaaggcagctcttcaagaatgtctgcttggcttgctcctgctcacgtggggtcgctgactcggcttcgtgatcgatgatatcaaagaattgctggatatagccgtttggccccagaaaatcatccccgctcattgaaaggaaactttggaagggctcttctttaactctggtctgagtcgcaacaaatttccccaattcaacgtacatccactcccccgccgcaaatgacggcaaaatctgcaggacactgtgagtttgaatggtggctgccatgtgctggcgatagagttggttaatcggctgaatggtggtttgcttcaatgattcccagtcatggggcatcgacgccggttcccgtttgagccaatcatccagcatatgaagctgcatgtcctgccgtttgtggaacaacagtgcctggtcggtggtcgtgctgtggtttatgagcgcattgatgaccgcaacttcgttatactcaaaggcgatgtcctgctcgtcgtagtaacggagttgttcctgtgataactgccctttgataattccttgaacaaatgggtgtttctcgttggcaatcaaatagggttgagcttcaaacaagatatcttgggataatgacatggtatttcctcctgtcgtggcgggtaccggcaaaaaaagaccagcggcagctaaattgcccctggtctttgcgtgtttgatgatcctcatttgcgttataaaaaacattttggatcggtcttcctgcgacagtcctaactgtatcaggttccatgggtatcatctcagccgttggggcaccccagaccacgtattatattgtgttacagttttgattataacgggttcggggtggaatacaaccgggaatttaatgttctgtccttcaagatgacaggtcacttcgtaacagtgacagtcgccgttgccgttgcggtcatgccgtccatcagtttgaaagtatatgtggtgtggtacgttccaggaagcttagtatttacgtcagtggatatttgaactcgatccaaccaatcccctctctgatagctgacaccggtcccatccatcacagaccagaggtaactttttggataataatcgtccccagtaagaatctgagcatcactgacaaagattatcggttgaacccaattcaaagtgatcgtgatcacattcttgtctttgtcaaaactaactgcaattgaggcatagttcatcggagttgggtcattagatttcaacgtctgcccgtcaccaagatccttgagcttagtggccgcggtatcgggattcttggtcaattcactcaaaacactagcgtactgatcttgatacatcttcaaaatttgattggaaacggcttggttctgggacgttcccaactcataaacattgtagttaattgtcaatggatttttggctgggacctcaacagttttcgtgaccgtatttgtcaccgtgttagtcacaacctcaggcggcgattgcacataattggtcacggtcgtggtcgtgttggttggtggcgttgtggcggctttcaggctgctgctgttcaaccaaccgttgaactcaggatgagtgtcatcaaccacatagtagaaagtgccgtagtattgcctggtgagctgtttggcggccgtcacccgcaattcatcgttagcgtatggcctggagtcagtcgtctttaaccgggcaccgtattgagaccatggaattgccgtccaggagttgctcgtccccgaaatgcctggatttcccagggtaaattttgcgttttttacatcgtctggtaacggaacatctttggtagtctgaacgctgcggatcccaccttgatagtcggccttggtctttcccccgtagatccagcctcgccacttgccttcaaaggagacgactttgtagtagacttggcctttgttggtcgttgccatgcggtagacgttgaagaagtcttttgaccgctgggaattgccgagttgcttgagctgtttggctgatgtcaccgccttggcgtttttcaatacgccggctttgttatagatcttgttcttgccggtaattgcaacgttcctattggtgactttggttgctgtaatgggtacgtttgacgtcactttgaccttcttagctgcgtcggcttgagttgtaaggatcattgtaccaatggcaaatgctcctgcaagtgcgcccataatttttaagttattcatatgaatcccctccataacccaactaatatgttatcactttaattccgattatattatatcagtcctacgggcaaacgcgatggataatgccctctaattcaactggctgttgggtttaggcatgatttgcctcggttttattaccctaggggaatgggctcggatcggtattattttatgcacattcaaatcgcggacttgaccttgccaaaccagtttgtcaaagtcggttagctatttaccaacgaattgttctataattaaggactaatgaacatttgggggaatgggcatgcaaacatatggactattatttgtcatcgcaattggctgttttggactggccttaatttgtttcagcctgattagcggcgaccaggaccccatgaaagcacatgcacccgaagaaccccgcttgtatgagggcgccaccccgcaatttgacgtggaagtggagccgggaacctatcagtacgatccggcaaccggcgagaccaacatccccaaaaacgaatttgacttgtacatgctctacaccatcgacaatgtggacaaaaggcacctgcggctgacgccagccgatcaagcgttgaccgacaaattgaaaagtccggcaggccactgggatcaatttcccaaggccattcagcacatgccggcgctctggacgattgccgggcatggtttggtgttgctgcgaattaaataaatcagatacaaaaaggacttgaagccaatttggcttcaagtccttttgcgttcagatattagtgcaaatcatcaaggattaaatttaatttatctttgataattccagaagtaataaataaaccacccggcttcaaacatttttttgcttgtggtactaaaggctcaatgatttcagccaaaatatttgccacaacaacatctgcttgtacttgaattccctcaagtaaatcatttggtttgatttcaatattttttacatctggatttagctttagattctccacagccgaatcaaccgccacctgatccaaatcaaaggccctaatttttcctgcccccattttgctggccgcaatacttaaaacacctgaaccagtaccaacatcaatgagttcttcgccaccacgtaaatacatttccaacgcctgcaaacacaattgtgttgtgggatgggttcccgtcccgaaggccataccaggatctaactttaaaatcttttcctcatcggccgtttttttgtaagtttcccaatcgggaactaccgttaaataacgggtaattcgaactggatgataatactttttccaagcagtttgccattccgtttcttctaatggcttttgcaagacgtttgcaggcactgggtctaaaccaaagcttataagttggtcaacttgatgtttaatttgtggtaacaagtcgtcaacttttattgattcaggataatacccggtcactgacgcaccacttttgatatgaggaatatccgccaaatttaagatttccccaaatcgaccagcgcgtaattttttataatcttcagcgtcttcgatcttaactcccttggatccagccgtttccaaaatattagtaactgcttctactgcctcatttgaggtttgtacaattatttctgtccatttcaaagttatcaatctccttaaatgttattgccaaccgtacgttttaaactcaatatcacgtttcctcatttttgatacataaggattccccgctacgaagtatcgtaacggttcagacgtccaaacacctttatttggaaccccaatccggccactctgaataatatgcgtcgccgttttaaagtcttcaagatctaagcttaaggaaccctcattcaaacgagtcccctttaaagacttagggatgccaaaggcttgcattaattttccaggtccactggtgagttcaaatggctgttgcacttttcgattcttacgaaattgagataatccctccgcaggttgtacggcacgaattaaaacaccctgaggatcgtcaactttttgagtaatcaaattcaagagcaattgcgttctcatttggtaaatataaatggtaccagcttcatgataaagtggttcatttttaggtgtccggtgtccttgaaaagcgtgcgctgcttgatctttaggaccgatatatgcctcatcttcaacaatgtaggcactcaacatcccaagctcggtttcaaaacaaatttttttgcctaataatttcttagcaatatctgctgtgtttccgctaaggagaaaatgttgaacctgttcaaaacttgttgtcatctaaaactcaccaatctatacgattaatttatgctacttgtattttacagctttaacttcatagaaagcaaaaaagaatttaatcctagtaaaggaccaaactctttagttttaaatttgaattaaagcatcattatttagcttttcgatcatcaaattctttttcactagcagccttttgtggtaagaccaaatttagtacaattcctaaaactgttgcaacggctaaacctgaaaactgatactgtcccaactgcagataagcatttccaatcccaataaccaagatagctgaagcaatcatgaggttacgtttaatattgaaatctactttctcatcaattaatacccgtagtccattggaagcaattgttccgaacaaaagaaaacttattccgccaattacaggtgaaggaatgctttgaattagggcactcagtttaccaataaaactaaatataattgcaaacattccggcaccagccaaaacataaacactgtggactttggtgattgccaaaacaccaatattttcaccataacttgtaacaggtgggccaccaacaaatccagcaataagagatgcggtcccgtcaccagccaaagtatggtttaatccaggatcttcaaagaagttccgtttagtcagtttgttgaggaccataatatgtccagtatgttcagtcattgtcacaaacgcaatcggcgccaaactcaaaaccgcgccccaataaaaatgaaaacgataagttaagaatgggacttgaaattttggtaatgaaaaccaagaagctgccataacaccgctgaagtctacaatcccgaacaaaacagcaaccacgtagcctacaacaattcccaaaagaattggaattaaactaataaatcctttcaggtacatgttaaatccaatcgtaactaatagtgtaatcatcgcaaccgcgaaatatcgccaatcgtaagtggttgaaccagaagtaagtgtgcgcatggtagcgtcagtcgcagccgttccggctaatgataagccaatcaccattacgatcgggccgacaacaatgggtggcaaaattttgttgatccattcagaacctacaaaacttacgattaaggcaacaatcaagtatactaacccgacagccaccgttccttgtgcaataccgggatatcccgttgttttcattaaagcaaccattgggacaataaatgaaaaacttgaacccatataagctggaatcttaccctttgtaataagtatgtatattagggtgccgacaccagaactaaaaagcgcaatcccaggattcaagcccaccaaaataggaactagaacagttgagccaaacattgcaaacatatgttgaattgataaaccaatccagtgtcctaatgttggtcgatcatgaatatccaaaacgacatcatcattgtgaaactcatttgttttcgccatttaaaatcctcctaatatattaaaacccctttgagttgttcgactcaaaggggttcagaataatagttagacttaatttattctagactaccttcgaagtctcacaggacatctttaaaggtttcattacagctaagatactctttaatttatcgaacgtcaactaaattggacaataatcctgctccacaaaaaaacgaatgactggcaacgtctgccatcactcgtttgttttgcttactttgattcttttttctcgtcaggttcgattttattagtcttcaatcgaccttttgccttttggttcacgtgctgcttcaaatacttaattagatcagattcacgtttaaagattcgaggatgctgctgtttatgcaggcgcaaatcaatttcgttaatcttaattcgtcctgtccaggtatgggaatacttgataatcaagcgattattcaaatcttcttttccaaacttaaaaacataaacactttcaggagtcattaatggtctgatataatgtttttcatacttatatttattggagttcatgaactgtttcgttcgctttaaaataaataacacctccaaaaaatttgcttaaagccccttgactcaattctagttaatcattatattaagctattcttcaaaaaaagtaaaccaatttgatgaacttatttaatacccgttgtaagtgaatttaatgaattatacttaatgaccactcactatttatcttttaattattatcattttgttcggtatctgtcttcaaaacggccatgaaagcttcttgcggaatttccacagtccctacagctttcatgcgttttttcccgcgtttctgtttgtccaaaagtttagcacgccgatcaggatcacctgtatgaattttagatgtgacatcttttcgatatgcctttatattcgttcgtgaaataatttttacaccaatggcagcctgaattggaatctcaaagttttgacgtggaataattttcttcaaccgaccagtaatttcaattgcgcgctgttgggcaaaatcacgatgagcaataaaactcaacgcatcaacctttttactgttcaagagaatatcgatttttaccaaatcacttggccgataatcttccaattcgtaatccaacgaagcatagccatgtgtccctgactttaacttatcaaaaaagtcaaaaataatttcagatagtggcaggtagtacaccacgtttacccggtaggtgtccaaataatccatggtgtcgaacacccctcgacgatgttggcataattccattactggacctacatagtcgttaggcaccattattgacgctttgacaaacggttccttcacatctttaatacttgacgcatcaggcagctcagaaggattttcaacgaccagttcactaccatctgttaattctacatgataggtaacagatggcgccgtcgtaataagatctaagttaaattcacgttctaaacgctcctgaacaacgtccatgtgcaggagacctaaaaaaccacaacggaaaccaaatcctaaggcttgtgacgattcaggctcaaactccaacgctgcatcatttaattgtaatttttcaagagcttcccgtaattcgttaaacttcgcattatcggttggatacaagccggcatagaccatcgggttcatttcccggtaaccatgtaaagcttccttagccggttgtttcactcctgtcactgtgtcaccaacacgggtatctttaatatctttgatactagccgttaaataaccaacatcaccggccatcaagtaattgcgtttgatcggtttgggtgagttcacccctacttccgtcacttcgtattcgctaccactattcattaagcgaatatggtcaccaggtttcaccataccttcaaacaaacgaatactcaacacaaccccacggtagtcatcgtactttgaatcaaaaattaaggccttcagaggaccatctaattcaccttcaggggccggtactttgtccacaatttgttccaataattctgaaataccgatacctttcttggcactcgcaagaacagcatcagacgcatctaatccaatgacatcttcaatttcagttcgaacccgttctggatcagccgatggcaaatcaattttattgataaccggaacaatttccaaatcatcatccaaggctaaatagacgttggctaaagtttgtgcttccacaccttgagcagcgtcaacaactaaaatggcaccttcacaagctgccaaacttcgtgaaacttcgtaggaaaaatcaacatgaccaggagtatcaattaaatgaaaaatgtatgtttccccatctttggctttgtaatgcaattcgaccgcatttaatttaattgtaattcctcgttcacgctccaaatccattgaatcgagtaattgatcttgcatatctcgttttgcaactgtatccgtcaattccaggattctgtctgccagagtggatttcccatgatcaatgtgggcaacaatcgaaaagtttcgaatatgttgctggcgatccttcaaatctttgtattcaggcattttaaatcccactttcatataacttcattcatcctattatagcaacgtttgaagccaatctcaattatttcattttcaaacctgtttgccaaaaagtaaaaacacgaaactaaatggcagacaagcgtcattaagaaaattaatttgcttgtcaaagttcaccatcttgttcgtgtttaagatactacttaaatttatcaaaaaatccattcttacctgaaccagaaaccttttcgccgccagctttagcgaatgcccgcatagcttctctttgttctgcattcatattctttggtgtttcaacaatgaccgtaacctgctgatcaccattaccgttacctcttaaacgaggggcaccttttccgcgcaaacggaaggtcgtcccggtttgagtcccagccggtactttcatcttaacatcaccatgaaccgttttaacttggatttcgtcacccaaagctgcctggacaaaactaattcgtttatccagatagatttcagcaccttcacgcttgaacactttacttggtgctacacggaagataatgaacagatcaccatagccaccacggtttgtacctgcttcaccctgaccttgtaatcgcatttgttgaccatcttcaacgcctgcaggaactgtcactttgacttcatgacgttcatttacatgaccagttccttggcaagttggacatttttctttgatttctttaccagttccatgacaaacgtcacaaacttgttgtgaaaccatccgacctaaaggtgtattttgagttacttgaatataaccggcaccatgacattttgcacaagtaactggtgaagttccaggttttgcaccagagccatcacatgtcttacaaagtgcttctcgattatacttaattgtagtttttttgccaaacacaccctcttcaaaagtaaggtccatttgatactgtagatcttcaccttgttgaggttgatttggctgtgcactacgacctcgaccaccgccaccaaaaaactggctaaaaatgtcatcgaacccgccgccactaccaccaaatccgccaaaatcagcagaattaaaaccaccgttaccaccaaatccagcatttgcatcagctgaaccatactgatcataacgagctcgtttttgatcgtcgcttaaaacttcataagcttcatttacttctttgaatttctgttcagctccaggagccttattcaaatcaggatgatacttttttgataattttcggtatgcctttttaatttcatcggcagatgcatctttggatacccctaaggtttcatagtaatctttattctccgccattatgatcctccatttttatcgataaacttagaatatcatagactaaatgtaataaaaagccaaagtcgatatgactttgactttttattaacaatcaagcaattcaatcacttattttttgtctttgtcaggatctacttcttcaaagtcaccatctacagttcctttatcatctttcttatcagatgaagctgaaccatctttttgatcacccttagcttgttcctgttgttgtgcttgttgatataattttaccgaaaggtcttgaacaatcttattcaagtcgtccttcttggtcttcatatcctcaacattattatctttttgagccttcttcaaagcatcttcagcatcttttgccttcttgatctcatcctcagatactttgcctttaagctctttcaaagtcttgtcagttgtaaagattaattgttctacttcgttcttaagatcaacttcttctttacgtttctcatcagcagcttcgttttctttagcttctttcatcattcgatcaatttcctcgtcagaaagacctgaagaactcttgatagtaatcttttgatttttaccagtgcccttgtcagttgccgaaacattaacaatcccgtttttatcaatatcgaatttaacttcgatttgaggaacaccacgtggtgccggtggaatatccgtcaattggaatcttccaagcgtcttgtcatcagcagccattggacgttcaccttgtaacacatgaatatcaacggctggttgactatcggcagcagtagagaacacttgtgatttgctagttggaatggttgtattacgatcgatcaacttagtgaatacaccacccatagtttcaatacctaaagaaagtggtgtgacatcaagtaaaacaacatctttaacgtcaccagttaagacaccaccttgaacggcagcgccaatggcaaccgcttcatcagggttgattgaatggttaggttcctttccagtccagtttttaacagcttcttgaactgcaggaatacgagtagaaccaccattaaggatgatttcatcaagatcacttgcagaaagatcagcgtcacgtaaggcattatcaacaggggtctttgttcgagcaactaagtcagaagtcatttgatcaaattgagcacgcgtcaaagttttttccaaatgtaagggaccgttagctccagctgagataaatggtaaactgatttgggcttcagttacaccagaaaggtccttcttagccttttcagcagcatccttcaaacgttgtaaagccatcttgtcttgagaaaggtcaacaccgttttctttcttaaagtcatcaactaaccaatcaatgatcttttgatcaaaatcgtcaccaccaagatgtgtatcaccatttgtagaaagtacttggaaaacaccatcccctaattcaaggatagaaacatcaaaagtaccaccaccaagatcataaactaagactttttcatctttatcttgcttgtcgagtccatatgctaaagcagatgccgtaggttcattgataattcgttcaacgtctaaacctgcaattttacccgcatctttagttgcttgtcgttgtgaatcatcgaaataagccggtacagtgataactgctttttcaacagtgtcaccaagataatcttcagcataatgtttcagatattccaaaatcattgctgaaatctcttgtggtgtataagacttgccaccagcactaactgtataacccttttcaccaatatgacgtttgatggaaacgattgtatccgggttagtaattgcttgtcgtttagctacttctccaacctgagtttcgccatttttaaatgaaaccactgaaggtgttgttcgactaccttctgggttagtaataatctttggtttgtctccttcgaggactgcaaccgcggaatttgttgttcctaaatcaataccaataattttattgcttgccattttattatccctctttttaatttattgtgacacaacaaccattgcaggccgtaaaacacgatcttttagcatgtatcccttttgcaggacactcactacttgatcagctttgccgccttcttcaacagccaccgtttgaacggcttgatgaatgtgtggatcaaatggttgaccaactgcttcaatctcagttacatgattgtcttttaaggccttattcatgtgatcaaaaaccatctgaataccctttttcagttgctttccattttcgtcagacacctcaatcgccaaagcacgctcaagattatcaatcactggtaaaatgtctttggctaagtgttgaccgtcatacttaaccaagtttgcctgctctttttcatttcgtttttgaatattggccgtttcagccttagcacgaatgtattgatcagttatagcatcaactttaccattcaattcggtaatttgtttttttaactcttcaatctgggtagccgtttttgattgtttcttggactttttttcgccctttacttttttatcgggtttaactttagttttttttgtttcttttgtttgtttttcgaccgtttcatcgatcttttcagtcttcttgtcttctgccactacgttcacacctctcaactatcatcaatatcgtggtaataatctatcaatcttcttgctagctctgttcggaacgcaccaaccaacccaatcattttggaatatggcatactcgttggtcccaaaactgcaataacacctttaccatgttgatcaacatcgtaagttgctgtaatcaaactataattttttaacagattattagtaatttcattaccgatttgaaccttaatattttgatctggcgaacccaaaacgctggcaagatccgtcgaatggttcatcaaactatataaagatcgaattgcacccaaatcatgctgtttggaaaaatccagtaaatttagctgcccaccaacaaagaatcgttcagttgctgattttttcaaaacatcttcgaaaacatccaagaaaccctctggcgtttcaatgtactttccgatttgattcggaatatccgttgctaatcttttgaaaacttctgacaacgttaaaccaactaattcatcattaatgatccgaataactgcttctaaagcttcaggatcaacgtttgaaggcaccttaaaagttctattctgaacgtcaccattgtcagttaccaaaatggccataacacgatgatttcctaatggaaccaatctgaacccttcaagctttgcatctttcaattcaggctttactgtaaaggcagtgtagctagttaacttagaaagcatatccgccgattcggcaacgatatcatcaatttcttgaaactgatgattaaacgaagaacgtatctgtcgcaaatcactcgattgaactttatcaggtttcaacaaatggtcaacataatagcgatagccttggatcgaaggaattcgaccggacgaagagtgagttttcttaagcaacccaatttcttccagcgtcgccatctcattacgaattgttgccgaactcacatgcatcggtaattggctaactaaagcttttgaacctactggctgaccatcactcgtatagatctgaacgattgcttgtaaaatcaataactccctatctgtcagcaaaaccatcacctcttttagcacttagcacattggagtgctaagacactattaaagataacaaatgttctttcaaatgtcaacattagtcaaacattttttgatatttgtactattctttttttaaaagcctacttttttgcttgtattaagagatttcgtccaaggtgctacagcattttttgatactttacgttctgatttaaatcagatttcaatggcaaggtattaactgaaaaatgcatctacattaatttgattttccattatttaaattcgcaaaatattgccggatgtttttttcatcggcctttaattgttcaattaatttgtcagcattcgcaaactttatttcaccacgcacatagtgataccattctacggaaactacttcaccatatatttcctgatcaaaatcaaaaatattgatttctaacgtgatcggacgattttctccaaacgtgacattacggccaacagaagccatcgctggccaccattttgtgccaattttgatccgaacagcataaattccaatccccggaattcgtacccatggatctgacaatacatttgccgtaggaaatccaagtgttcgtccccgagcttcaccatgaactactaatccactagtttggtaaacatatcctaagaacttgttggcatgatccacatcacttttctttaaatcatcacgaattttggttgaactaactttttgaccgtctaataaaaattcgtttactgtcacgatatcaaaacgatctttggaataacttggtaaatgagtcatatccgcaatttcacgtggcccataagtatagtcaaaacctgcaacgattgcttttgcatgcagattaaccatatattgatccacaaattcttgaggagttaaatgcgcaaaagtggatgtgaaactgaccacatataaaaaatcaacacccaaactagtcattaactcagcttttcgtttaactgaggtcaaataatgtaaaccatttagacccggtttcggaaaaacaacagacgggtggtggtcaaaagtcattgctgcaagcggtaattttctttgatcggcttccttgcgagcacacttgataactgcctgatggccaagatgaacgccaccaaaaaatcccattgccaaaacaacatctccatgaggaatttcttgagtctcatatggatgatgtaaataaataattctcataaaatcctcccaataattctaaatatcacgttctcaaaactctcttagttagttggttaataacatggtcatcggccgataagctacccgtttttcatcatattggtatagtgcttggacccgatcgtgaaaagtcaatgccaatacaggggctgcatttttcggctgatcaaaattacttctctgtaaaatagcaccgttttgaactctccgccaaagatcggcattcagttcaaaatgcggataattttttaacgcatgatcaaggggccgaatcaaagtatcgatcgtattagtttcaacagccgactccaactgagcaaaagtcaccgtttcatctaatttaaacccgccactacttagcctagttaattttgacataactgccggcacacctaaaatctcacccagatccaccgccagcgtccgaacgtaagtccctttactgcacacaactttgaaattaacagtttgggtaccattgatcttatcgaaaacggaccgggcttgtcgttcaaacgtatgaactgttatttgacgttttggtcgttcaacttcaataccctggcgtgcatattcatataacttcttgccattaactttaattgcagaataaattggtggtatttgagtaatctcaccagttaaccgaagcatagccatatcaatttcagtatcagaaaaagcctgactaagaattcgtttcttgataacttcaccatctaaatcttcagtagttgtagaaaaaccaaaagttacagccccttcgtaaaccttacctgatgccattaggtagtttacgactttagtggcttttcccacacagattggcaaaaccccgtctacattaggatctaatgtaccactatggccaacttttttttgatgaagaataccgcgaattttggcgacacaatcaaaacttgtcatgccccgcggtttatacaaaggaattatgccatccatataaaacgacctccattttttactgctttaaattatagcatagcttcgccgtttcctttgaattttggcatcaaaaaaagaatggccattaaattccagaccattcttttgcgtatttataaacgaaatcgattaatcttctgaattaagtttattgatcaacttatcaatacgatcgccatattgaactgaggcatcacgttcaaaaattaattcaggagttttataaattgacagacgagaacccaattcgctgcgaatcaggcctttagctttttgcaaaccggtagcaactctttcaccatcggaagccttatctgacaaaatactatagtaaacagttgcttgctgaagatcaccagtcacattaacaccagtgatggtgataccctgcacgcgtggatcacgaacacgtttacgaataatatcactaatttctttctctatttcctgaccaagacgatcagctcgatataatcttgccatgtggatcctcctattctacaggaacctctttcatgatataggcttcgatgacatcatcaactttaatatcattatagccatcaattgtaagacctaattcaaagccttgtttgacttgtttagcatcatctttaaatcgtttcaagctggctaatttaccttcgtaaattacaacactgtcccggattaaacgaacgccactatccttttgaatatagccctccgtcacataaccaccaacaacagttccaacatgggaaactttatagatctgacgaacttcaacttgcccagtaatgacttccttgtaagttggttcaagcatccctttcatagcggattctacttcgtcaattgcgttgtagataactcgatgtaaacggatatccacatttgaagaatccgccaactgcttagcctgattagttggacgaacattgaaaccaatgataatggcattgctggcttcagctaacgccacatcactttcattaattgcaccaacagcggtatgaataatgtttacccggacgcctttgacatcgatcttctttagactgccagacagagcttcaaccgaaccctgaacatcagccttaatgataaggtcaacttccttcatttctccttctttaagagaatcaaacaagttatccaaagtgacatgattatttgcacggcgttcttccatcaatgattctttggcacgttcttcaccagctgcacgagccgatttttcatcatcaaagatcacaaaacggtcaccagcttcagggacatcattcaaacctgtaatttcaactggggttgatggcgtagcttcttttacacgacggcctaattcatttgtcattgttcgaacgcgaccaaaggtactaccaaccacaattggatcaccaacacgcatagttccttgctgaactaaaacagttgcgattgaacccttaccaggatcaagactggcttcaattacagagccagctccattttgttctggatttgctttcaattccataacttcggcttgaagtaagatcatgtctagtaattcgtccaaattcttaccaaatttagccgaaatttcaacgaaaatcgtatcaccaccccagtcttcagaaaccaatccatattcagtcaactgttccataacgtgttttggattagcaccaggtttatcaattttgttaacagcgacaataatgggtacattggcagccttcgcatgattgatagcttcaatagtttgtggcataacaccatcatcggctgccacgactaaaatggtaatatctgtgatatcagcaccacgagcacgcatttcagtgaatgcagcatgtcctggtgtatccaagaaggtaatcaacttaccatcatgcttcaactgataggcaccaatagcctgagtaatcccgccagcttcaccagcagtaatatgactatgacgtaacttatccagcaaagttgtcttaccatgatcaacgtgtcccataattgtaacaacgggaggacggctttcaaggtggtcagtattttcagcttcttcttcaaacatcttgtcaatatcagaaacattaacaacttcttttttctcagccttgattccgtaatctgcggctaaaatttcaatcgtatccttatcaagggtttgattttgattaaccatcacgccaagcataaataacttcttgatgatttctgctggctcacgatgaatttttttagcaatttcggctacgttcgttccatcgttgtattcaaaaacttctggtaatggcttattttttcttgttggtgctggtttgttatctacttgacgtaaacgaccattcttcttactcttcttattgtatcgaccacggttattataacggttattattacggccaaaacttgaattgcgattcccctgtgaatttccacgacgactatctcttgaagttgaagaaccctgcgaattactatttgaccggttgtttgtatttgatcgattattattatttgatgaacgattccccgcatttgaagaattgctctgcgtggaccgttgttgtgaattacgattctgagtactattttgattatttcttgagttagtccgcgattgattttgttgactagagcgattttggctatgtgagccgttattagcactctgattttggtgttgcgggcgattagaacctgtttgactagccggacgattgtgtgtttgttcagtcgtcttatggttattatttacagattttgtttcttgaggtctttgtgatgtctgagtagttttatgttgcacactagtctcctgtttgtggccagatgcacgttcaacgactgttttaccagtttttgctgaccgatacatagttggcttcttctttggtgtttcagatttttggttattttttgtagcgaatgattgtcgaatttggcgttcttcattctctccaagggtagacatgtggtttttaacatcaaaaccagacgctttagctttggcaataatatccttactagatacattaatttccttagctaattcatatatgcgttttttccccatatcttcacgctccttcttcaatatttaatttcaataaagcttttgcaaatccctgatcttcaattgcaacagctgaccttgactggccaatagcctggcttaatgtttcacgagtcataaaagctaataatgggatttgataagttgtgcatttatcagagatttttttctgggtcgctgcacctaaatctgtgctaacgacaatcaatttagctttttggcttcgaattgattgtaacacttgttgttccccagaaatcaattttcccgctcttcgtgccagtccgagcaaattggaaaaccgatctttatcattcatctttgaaaagttcctttcgagcttgttgatgatctacataagcaataagttcatcgtaaaactcatcagcaaccttaatcttaaatgttttatcaaaagttctctcatcttttgcctttttggcaattttcacatctaacccaatgtaagctccacgacctggctttttcccagttgggtctaaagaaacttcatcttgtttatttttaacaactcgaactaattcccttttggggaacatctcacccgttacaatatctttacgtaacggaatttttcttttcttcatagttatcgagcctcctaatcaactattattgattatcttcactttctgaatctgattctgtgacgtcgtcctcttcaggttcttccattaaatctttggcatcagtttctgattttatatcaatcttataaccagtcaacttagcagccaaacgggcattttgtccgcgtttaccaattgctaatgaaagttgataatctggaacaatcaccatgcaggtccgttcattttcttcgtcaaacaagacatcgacaacttcagccgggttcaacgcattggaaatgtacttagcagcatcatcttcccattcaacaatatccatgttttcaccgtttaactcattaacgatggtctgaacacgttgacctctgggacccacacaggttccaacagcatcaatatctggatcggttgaacggacagcaactttcgcacggtcgccggcttcacgagccactgaaacaatttcaactgtgccatcaaaaatttccggaacttcttgttcaaacaaccgcttcaacaaatctggtgtgcttcggcttacaaatacttgtgcacccttgccactattttcaacttttgtcacataaaccttaatatgatcatgcggttcatatctttcagttgggatttgatcttgtttagacatcacagcttcaacaccaccaagatcaacatagacaaaacgattatcgcgacgagcaacttcaccagtcacgatttcattttcatattcactgtacttattataaatgatttcccgttctgcttcgcgaacccgttgcaaaataacttgtttggctgtttgagcagcaatccgaccaaagtttttaggagtcacttcaaacttaatgtgatcacctagttcataagctttgttaatgcttaacgcatcacttaggcttacctgttgttgatcgtccaaaacctcatcgacaacttctttaactgcatatacatgaatatcgccttttttgtcatcaaactctacatccacattttgagcctgtccatagtttcgtttataagccgaaaccaaggcagcttctaaggcctcaatgacaacttccttcttaatccccttctcctcttccaaagtattgagggcactaatcatttctttactcattttaaattctcctttttaaaacttgattgcaaaacgcgcaaatccaatttgtttaacctcaaattgtttagtaatttttcttgttttattcatgtaagttagttttattgttgtgcctgaataatcatctaaagttccttcaaaaactttttggccatcaattggggcatacaacgaaatatgcacatactgtcccactgctcgttgccaatcattcgaagttttaatgggccgttcagctccgggagaagaaacttcaagaaaataggcctgaggaaatggatccggctctaaactatctagcttttcactgatctgatcgctagcctcagcacaatcttcaattgtaatcccacctggtttatcgatataaacacgaagataccagcttttaccttccttaacaaactctatatccaccaactcaaactggtgggattcaataaggggttctacttccttttgtactgtttctacaacactcgccaaacttaaacctccaataaaattcaaatattttcaagaaaaagagtgagcattttctgctcactcacttgccgcaattagattcactataagtataacatatcgcttaataacgtacaaataagctacatatcaaacaacgataattgattttcatctggtaaatccgacaaaacaccattttctgtcataaaatcaatcaaggtctttgaaaccttgcctcgtttagacagatcttcttttgaaagaaatggtttatcttcacgagccgccacgatctgtttagccacgttcaatcccagtcccggaaccgcgttgaatggagctaatagggagtttccatcaattaaccactgtgaggcatctgacttattgacgtccaccattttaaacgtatacccgcgctctatcatctcattagccaattccaaaacagtcaaaagatttttttctttagtagacgcatccatccctttatcattaatagccttcattgcacttttaacagcatctttgccatgagacatagaaactaaatcaaaatcgtctgcccgcacactaaaatatgcactgtaatataaaattggaaagtaaactttgaaataggcaattcttaaagccatcaaaacatatgcagaagcatgtgcacgtggaaacatatatttgatcttcccgcaggaatcaatataccagtctggcacatttgattgtttcatcttttcttcatcaccatcaggaattccgcggccatgtcgcacactctccatgatctggaatgaagtttgggaatccataccataatgaattaaatcggtcatgatattatcacgacacccaatcacatctttcaaggttgccgtccctgctttaattaattcttcagcatttcctaaccacacatcggttccatgagaaagtccagaaatttgaagtaattcggcataggtggttggatgggtttcttccaacattccccgcacaaatcgagtcccaaattccggaacgccgaaagtccccgttttcgactgaatttgttcaggagtaacacctaaaacttctggcccagaaaacagtttcataacaccgggatcgtccgtcggaatcgttttaggatcaatccctgataaatcttgcaaggcacgaatcatggtaggatcatcatgacccagaatatccatttttaaaatattgtcgtgaattgaatggaaatcaaaatgcgtcgtttcccacgctgcagtttgatcatcagctggatattgaatcggtgtaaagtcataaatatccatgtaatcagggacaatcaaaattcccgctggatgttgaccagtggttctttttacgccggtagccccctttgacaaccgatcaatttctgcatttcggaaagttttcccagaatcacgttcataagcttttacataaccataggctgttttatcagcaacagttccaattgttcccgcacggaatacatttttcttaccgaacaaaacctgcatatagttatgggcaattggctggtagtctccagaaaaattcaaatcaatatcaggaactttatcccctttgaaccctaagaaagtttcaaatggaatatcttgcccatccccaaccaatggtgtttgacatttaggacaaactttatcaggcaaatcgaatccagatccatattcacctttagtaaagaattctgtgtattggcagttagggcatcgataatgtggtggtaatggattaacctccgtaataccagacatcgtcgccactaaactggagccaactgatccccgagaaccaactaagtaaccatctttattacttttgtgtacaagccgttgtgcaattaaataaataacagagaatccattcccaatgatactctttagttccttatccaaacgttcctttacaatctgtggcaatggatcaccataaagttcatgagctttatccattgtcagttgttcaattctattttcagcaccaggcattttgggagtatatagtttatctttaactggcttgatttcgtcaaccatgtctgcaattttagcaggattagtgacaacaatttcctcggccttttgtttccccaagaaggcaaattcctcaagcatttcatctgtcgtccggaaatgcacatctggcaatgttgaacgattaagtggattagcaccaccctgagaattaattaagatttttcgataaatgtaatcttcaggattcaagtaatgcacatcaccagtcgctacaaccggtttgtgcagttcagtaccgagagcgacaatatttgataaaatctcttccaaatgacgattatcttgaatgagaccctgctcaatctctggttgataaactggctttgccatcacttccaaataatcataaaacttagccttttgtttggcctcttctttacctttttgcatcatggccgtaaaaacttcgccactactgcatgcagatcccacgattataccatcacgaagtcgtgatagttcagacttaggaattctaggtaccctgtagtaatattgcacattagaaagtgatactaagcggaacaagtttttcaaacctgcctgagtggttgcaagaagcacagcatgtgaaggccgggcatgtttgtaagcatcgttttccgtcatatggtcgttcaactgactgtggtacttaatatgataccgatcttcagcatcttttaaaaacaaatgacaaaggtggccagtagattcagcatcatagattgctcgatgatggtgttccaaactgacgccaaattttttagccagtgtatttaaacgataacttttaagtgttggatacaaaaaacgagccaaggttaaggtatcaataatcggatttgttactggaggcatgttataacgagcatacccagtattcatgaaaccaatatcgaaggtcacattatgacccacaatgatggcatccccataaaactctctaaataacgtaaagacgtctttttcagatttcgatccacggaccatctcatttgtaatacttgttaaattcgtagttaattcagataatggaaagccaggatcaataaactcttcaaactggtcaatcacattaccatcctgcattttcacggccgacaactcaatcactttatcgtaaatggctgataggccagttgtttccacatcaaatacaacgtaggtggtcccttttaacgggatttttttatcattgtaaccaattggcacgccgtcatctaccaaattggcttcaaccccatacaaaactttaacgccattcttcttacctgcggcatatgcttcaggaaatgcttgcaggccagcatggtcagtaacagcaatcgctttttgtccccattttgctgcctgttgaacaaagtccgtgatattgttggtcgcatccatctgactcatgttagtatgcaaatgaagttccactcgttttttaccttcaggtgctttgtcctgccgggttgcatgactaatctccattacatcataagcattcaaagttaagtcgcgcataaaagtatcttcttgaactgttccacgcactttaacccaaagtcccttttgaatagtagaaaagagttgttcttcagcttcattctttgaaaactttttgactgtaatggaagaactatagtctgtgatcttaaatattaacaactgtcgcttagaacgcagggttcggacctcagcatcaaatatatagccttccgcaacaactgaccgttcttcttgggtaatatcttctaatcgggtgatagcttcatcaggattaatttgtttaccaatgcgaacaggccccccatctggaataccactagcctgttttttttgtcgtttttcatcttgtttcagaattgcctgcgatgctttttgtgccaaaattgcatcgtttttctcttttttcgcctttaattcttcaatcatactttgtgaatcggactcatcgacaattgtgtggattgaaaactcaggaaatccatattgttgataagaactttcaattggtcccaaagctgtggtggttaaaaaattttgaaccacttcattttgcgccgcaaacaaaattctaccgtcattcaggcttggtaaattatgtccacataattcttgtgtgagcggagatgaaatatgactatttttcacaatccattcccaataattatcaattaaacgaatatccaacttggcatttgaagtctgaatattaaaagcaactcgtgcaatcgatttaaaggcgatttgtaaatgattatcaagttgttgaaaaactgcaaagggtaaacaatcctcaaatttaaaagagaattcccataccttcgatttttgatgaacaacaactttcttaacctccgcatttacaaaactcggatcatttggttccggataattaatttgttcgagaagttttttaaattgttcattagaatttagactcaagatttgattccttcccttttttacaaaaactaataatcatgaagataacggcaaattgatatatagactgaatccttcatcaacttgccgttatattaactcatttgttggtaacgtttcctagttttcatccttcagaagaatgccaactgaatttttcaattcctcaattttaacttccaaggtttcacctgttttacgtaatttcacttcaacaataccttctgaagattttttaccaaccgtaatccgaacaggaataccaattaaatcagaatcagcaaacttcacgccagcacgttctttccgatcatcaaccaaaacttcataacctgcttcagtcattgtttcttcaatttgcttggctaaggccatctgctcgtcattcttagcattaactggaacaacatgaacatcaaatggtgcaatattctttggccaaactaaaccatggtcatctgctttttgttctgcaattgcagataacaatcgactaacaccaattccatagcaacccataataaccgacttagcacgtccgttttcatccaaaacggtggcacccaaagcatctgagtaacgcgttcccaatttgaaaatatgaccaatttcgattcccttggtaaactgcagcttacctttcccatctggtgcaagttctccttcttgaactgttctgaaatcaccaaattgattaaccttcaaatcacgatcgatatttacattcttatagtggtatccattttcattagctccagtaactgcatttaccatgtttttgacataaaaatcagccaaaattgtgatattttcagcatccacattaacggcacctaaggaaccaaaatcagcatttaaatacttttcagcttgatcatcatttgcaggtactaactcaccagcattcaaaaagtttttaactttaacttcattaacttggtcgttaccacgaactaagacaagaactggtttttcatcggcaatgtacaataacgtcttaatgagcttctttgagtcaacgtccagaaatttggcaacttcctcaattgtcttagcatttggtgtcgcaaccttttccaatgtcattggttcttcacctgcagaaacatcatctacatatttactgcttgccatttctaaattagcggcataatcactttcttttgaataggcaatcgtatcttcaccaacaggagctattgcagagaactcttttgaatcattaccacccattgcaccagcatcaccaacaatttctcggtaatctaaaccacaagcatcaaaaatattttgataagccttttccatgtcacggaatgttttgtccaaactatccgtctcagcatggaacgaataagcatctttcatcaaaaactcacggccacgaagcaatccataacgagggcgatcttcatcccgatatttcatttgaatttgatacaaagtaaggggtaattttttataagatttaacttcatcccgaatcaaagttgtaaaggtttcttcatgtgttgggccaagaataaaatcacgatcatgacgattcttaaatttatacaactctggcccgtatgtttctaatcgtcctgacttctcccaaagttcagcgggtaaaacagcaggcactagcatttctaccgcatcgattttttccatttcagaacgtatgattttttttattttttcaattgttcgaaatgcgagtggtagatacgcatacatcccggcagatacctgacgaatatacccagcccgtaacatcatttgatggcttttagcttcagcatcatttggaacttctttcaaagtcggaattaacatttttgattgtttcatattttcctccgttagtagttattatttaaagaaataccgttgaatatcgttccaggttacagcaaccattaaaagcatcaaaagtccgaaaccgatgagggtaattataccttccgtttctggctttaatggtttacgacggatcccttcgataaagttcaataaaattttcccgccatctaatgcgggaattggaatcaaattaacaattccaaggtttagtgacagataagccaacatggtcagcaccgaaacaaagccaagtttggctgcctcagaagtttgtgcataaatagcaactggtccaccaaaatcgttcacactaaatccatgcgttatcatgtgtccaagaagtgtgaaaatcatagttgtcaatttccaagtttcagtaaaaccgtacataatgcgtgcgccaagattgcgtgtcatcgaactttcaatccctatctggccaacttgtccttcatttcccttaaccgacttcggaactaaagtataagttaatttctttccatttcggttaacttcaatttttgtttttttctttggtcgactagaaattgtgtcctgcaaatctgtccacgaatttgtggattgccctgcaactgacacaatttgatcattagtttccaaaccagcttttgcagcgattgagtctgagacaacagaaacctgattggagttggttgggactgctccttggagaataccaacaagggcaaaaacaatgattgctaaaatgaagttattcattggcccagcaaaatttgtaagaattcgttgccataactttgcagattgaaactgaacatctttaggtgcaattcgaactttggttccatcactttcaattatggatgcatcatggtcaacttcatagcgctttaagttttgttcgtcaccattttcgtagccttcaatccaaagctcagtctccaaatcgctattcgtcacttcaacaggaatgccgtttaaaagagttgtatcgtgactagtattaattgtctcgatttttccatttttaccagtaattaagctgactggcatccccggtttcagctcctcaccagaatcttctaatcctgccatgcgcacataaccaccaaccggcaaaattctaagggtatatgtggtcgcattcttagaataagaatagattttaggacccattccaatcgaaaattcacgcactaaaatcccagactttttggcaaaataaaaatgaccaaattcatgaacaatcactaaaataccaaatacaattatgaatgtaataatcgtttgtatcaatggcaaacctcacttaattagattaatccgaataaatgaataatcggtaagacaagtaacatgctatcaaaacgatcgagaattccaccgtgacctggcaaaatattaccagagtctttcacggagaagtaacgttttaaggccgattcaactaggtcaccaaattgaccggttatagagaatatcaacgttaacaagaccattaaaatgaaattatattgggttggataaaaaattaaaaatacggaaccgataattgtagccacaacagtccccccaatagaaccttcccaagtcttgtttgggctgatatggggagccagtttattttttccaaaccgcttaccaatcatataagctccactgtcggttgaccaaatgacaaacaaaatatataacaacatggacaacccaacacctctagccgctataaagtagtaaaaaccaaacccaatgtacaacatcgctaaagtgaccgcacccgcatcgtcaaaagaaaaacgattgcgactaacaactgttcgaatcaataacgcaagtacacacaagaagaaaacaaaaacacgatcaatttggggtggcaaccagccaaaccaactaagtggtgcaattaatgaaaagacacctatgtctgcaataattgcttccggagaaaccaaaagtaactttttcatcattaaaacttcattaacagcaatcaatccaagcactatgccggcgatgtcgattagccaacctccgtaaacaataaccggaataaagataatcaaggcaataactgctgttgtcacacgttgtttcatattataaactcccttattttaaaccgccaaaacgacgattcctttgttgatactcataaatacaatctcttaatgtcgcatcagaaaaatctggccacaattgatccgtaaatactaattcgctataagcaatttgccaaagtaaaaaattagaaattctttcttccccgcttgttcgaattaacaaatccggatcggaataaggttttaattccgcagtcattaacatcgaatcaattgtcttatccgtaatttcttcagggctaattttattctgatccacttgggctgcaatcttttgaacagcggtaacaatttccgctctaccaccatagttaagcgcaaagtttaacaccattccagtacatttttccgtatctgcaattgcatttttcacggctttttgtgtatagtctggtagctgatcaatatatcccattacattcacgcgaacattatgtttaattaaatctggtacaaaagtatcgaaaaagtcggttggcaaatgcattaaaaaacttacttctgcagatggccgtttccaattttccgtagaaaaagcgtacaaagtcaaaactttcacgcctaacttactagcactaatcgtaattttcttcacggtgttcatgccttcccgatgtcccgcaattctcggcaaatgctgtttctgtgcccatcttccgttaccatccataataatagctacgtgactgggaatattatgatcatctaaggtattaaaagaaagcttttcgtctttacccttttgagtatttttagagaacactttaccactccatctcatattcatgcataatgtctattttagcagaattcttcagaagttaacattcctagcaaaaaaaagctactagttcttcaattttaaattaaaattgataataaaaaaacacaaacagcactgataattcaggctctttgtgtcaattagtcattaaaattactcagataaaacttctttttctttatctgctacaattccatcaacagctttaattgcggcatccgtaactttttgtgtttgagtttctaaatcatgcaactgatcttctgtaaaggtactatctttttcgccttttttaagctcatccattgcatcgcgacgcacattacggactgctactttagcgcgttcaccttcagctttaacgtctttagctaactctttacgtctatcttcagttaactgaggaataactaatcgaattgcactaccatcatttgatggattaatacctaaatctgacattaaaattgcttgttctaagttctttaaagctgatttgtcataaggcgtcaccataattactcgagcctctggaatgctgattgaagccatttgattaacaggtgtcggtgttccgtaataatcaaccttaattcgatctaacaaactagcattagcgcgtcctgctcgaatatttcctagctcacgttgcaatgcctgttcagcctttgccattttgtcttgcgcttttttaataatttcattttgtgccatattattttccccttactgtagttccaattttctggccttcaacaacttttttaatatttccaggttgatttaaattgaaaacaaccaacggaatattgttttccatagatagggaacttgcagttgtatccataacattaagtcccttatctataatatccatatgtgtcaactcttcatatttgatagctgaagcgtctttgttaggatctgcagagtaaattccgtcaacaccattcttagccattaaaatagcgtccgcatttatttctgcacctcttaatgcagcggtcgtatcagtagaaaagtatgggctaccagtaccggctgcaaaaatgacaatcctatctttttctaagtgacgaactgccttccgacgaatgtatggttcagcaatttgacgcatttcaattgccgtctgaacacgagtgggaacacctaacgattccaagctgtcttgcaaggccaacgcgttcattactgtagctaacataccgatatagtcagcttgaacgcgttccatacccatttgttcaccagtttcaccacgccacatattaccgccaccgcaaacaattgcaatttgaacgcccatatcatgaacatcttttaactcttgagctactgttttaataacaggtggattaattcctgatcctttatcgcctgcaagtgcttcgccactaagcttcatgattacccgtttatatttaacttctgtcatggtgtttcctcctcgtttcttccgttctagtttatcataaaattagccaatagagccatctattcgctaatttagtaaatagttcgtttctatgtagcaaaaaaggtgtcttgttttcacaaaacacctaaaactgtaagtaaggactaagaactagcctatttacccatttcttttttaacttcttcagcaaagttagcagatttcttttcgataccttcaccaacttcataacggataaatgatttaacctttccaccctttgaagccacatatttagcaactgtttggtctggatctttaacaaaatcttgatcatcaagactaatttctgctaagaatttgttaagtcggccttctaccatcttatcgataatttttgctggctttccttcttcttcagcttctttggtcaaaacttcacgttcatgatccaagacttcagcgggaacctgactacgatttacatacttaggattaattgcagcaacgtgcatagcaatgtccttagcagtatcatcatcagcaccatccaatacaactaaggtagcaatcttaccacccatgtgtaaataagcaccaaaatgttcgttttcagattttttaacaacatcaaaacgacgtaaagtgattttttcaccagtcacctgagtggtttcaataatgtcatcattaactgttcccttagcggtttcaagcttcaaagcatcctcgatagatgcaggagcactcaaggcaagttgagaagtaactgcttttactaagtcaataaattgatcattggaagcgacaaagtcagtttctgagttaacctcagcaatagctgcttgatcattatgaatttcaacatcggctaagccttcagcagcgattcgatcacttttcttttcagctttggcaatccctttttcacgaagaaaatcaattgccttatccatatcaccatcagttgcgactaatgcttttttagcatccatcataccaacaccaattttgtcacgtaactctttaacttgtgatgcagaaatacttgccataattatggcctccttttagtaaattctaaattccattaaaaaggccatctcaatctcaggccaaaaaggtcgagacttacgacagcctaataattaactattttgcagagtctgatccgccctcaacagtttttttgagattctcaagagaatctgtcgaaacgtcacttgctgcttctttaacaggagctgcactttcagttgctgctggttgagcatcgtcttgatcttcaccttgacggccctcaataacggcatcagccatttttgaagtaatcaaacgaacagcacgaatagcatcatcatttgatgggataataacatcaatttgatcaggatcggtattcgtatctaccatagcaataattggaatgttcaacttacgagcttcttttaccgcgatttgttccttacgaggatcaacgataaaaatagcatctggaacatgtggcatatcttcaataccacccaagaacttctccaacttgtctttttgtttgttaagaagagaaacttctttctttggcaaacgttcaaatgtaccgtcttcattcatttttttgagatctttaagacgtttgatacgagtttgaattgtgttccagttagttaaagttccacctaaccaacgatggttaacataaaactgacctgcacgtgtagcttcttcttcgattgcagtttgtgcttgtttcttcgtaccaacaaataaaacaacaccattgtttgctgcaatatcttttacaaagttgtacgcagaatcaatcattttaactgttttttgtaagtcaatgatgtaaattccgttacgttctgtaaaaatgtatggcttcatctttggattccaacgacgtgtttggtgaccaaagtgaacaccggcttcaagcaattgcttcatagaaattactgccataataaaaatacctccaatagttttttccttcccaattttcctttgatttgagaactcaatgagcactggtcaaatcatccaactgggtgtgaatttggtttaacaccagcaataagtataccgaaaatgcgcatttaacgcaagtaatactttcatttttatgccgttcagagcaaaaaaaagtttacacaccttaataatgtgtaaactctttgaatcaattgtacttaatcaaattagtcaaagctaacttcgttgtcagccctaccattttcgatgaagctcttgttgttgtttaatgaaatttgaaccatgttcttaacagcttttgttgtatagaatgctgcatgtggtgtaatcaaaacattgtcacgagcaaacaaattattgaaaacatcatcagtaatcttttcacctttatggtcaacatcaaagataccgacttcattttcgtaggtatcaaggccagcaccagcaaccttaccattatcaagggcacgaatcaatgcatcagtatcaattagtgagccacgagcatagttgaggatataaacgccatctttcatcttgctgaaggcatcatcgttcaacatatgatagttatccttcaaagcaggaacatgcaatgtaatgacatcagcttgagcgtagatttcgtccaaggtgtcaacataaattccttctttttccaattcaggattacggaaaacatcatagccaataaccttagcaccgaagcctttgaagatgtccattgcagcacgaccaatacggccagtaccaacgacaccaacagttaattcgttgagttcttgagcaatgtctggagcccaacggaagtcacccttagacatcttatcttcaaatgttgggatacgacgtaataaggacatcaaaccagtaacagataattctgcgattgcgcttggtgagtatgcaggtacgttagaaactttgatattgtatttcttaacggattcaactggtacattatcaacaccaacattacgtaaggagaatgcatggattccaaattcatccatcttcttaaagatgccatcagtataaggtttttgctgataagcaacaaccccatcataacccttggctaaatcaatattgtcttcagttaaaagctctggaacagcctttacttcaacactgttgtctttaacccattcatccaaatatggtttttcatcatcacgaataccataagcaataattttcattacaaaaattcctccttaacaaatgtatctttagtatagcacatcgataaaaattaaagttaactttcctaatcaatgtacttgaacaccatgttcatgtaaaaattctagtttgttttctctagcttgatgtttaaaatggtactcggcactcaaagcgtcatgtttgttgtcaaaagtttcatagtatatcaaacgcactggtctgcgttttttcatgcgcgtgtacttagcaccctttccagcattgtgagttgccacacgggcttttacatccacagtaaatcctccatacaaagtgccatccgcacataacaaaacataaaagaaatactgacgagttttattttcttccatataaaaatcctttaacctcttgcgagtattcttcaccctcatattcatacaacggatccatgaatcggattccatctggccgtccatctttaatcgcttcaatcaaaaccatattggcttcattatgcggacgtggatagactaatcgaatccttttgggtgctagtcgattttgttttaaggcttctaaaatttctaaaaaacggtccggacgatgaactaaaaataacttgccgttcatttttaatagacctgaagataccttcaaaacttgattaagggttgttttcacctcgtgtcgtgcaattgccagataaggattaggatttttcttactggtagtctgattgcgaaaatatggtggattgcaaagcacataatcataagaatctttattaaacttttggaaggtgtctgcaagatctaagttatacattttgacacgatttcctagctgatttaattgaatacttcggtcacccatgtctgcaagcctatgttgtaattcaagctggtcaattgatccctttgtcttttgactcgcaaacaatcccacggcgccattacccgcgcataagtccatcactttagtttttggcgagttttttaattcagcgaaactcgccaacaaaacagcgtctaatgaaaacgagaaaacatctgggctttgaattattttaatatcctgactgtaaagctgatcaattctttcgtttttctttaaaatatcggtatctttcattttttcctcttattcattacttgcaacaattttggtttttgttcatacttaagctattaattcagcatgacaggagaatcatatagtggtttattcatttttaagagttttaatacgagtattattatacattatcaatggacgtccccattacttaaaccgcaaaaatcttccaaaagggtcttacattttagttggaccccatcgcacctggtttgatccaatttattacgccctggcagccagtccaaagaaattttcgttcatggctaaagaagaactattcaaaaacccaattattcgttggatactggttcactgctatgctttttcagtaaaccgaacaaatccaggtccttcagcaatcaaaacacctgttaatattcttcggcaaggaaaattatccatgattatctttccgtctggatcacgtcatacgcagcatttaaagggtggtgctgtagtcattgccaagatggcaaatgtgccaattatccccactgtgtatcaaggtcccctaacatttaaaacacttttttctagaaaaagggcaacagtagattttggagaacccattcaaatcgatcgcaaacaacggatggatgaagctggtcgtaatgcacttgatgcacaacttcaaaatgcattcaataagcttgataaagagatcaatccagactttaaatatgtggatgtttctaaaaaataaaaaatctgtaaacagttaaatctagcactgtttacagattttttattaggcatctaaaggttgaaagtatcaaaattattatatcagtgtgttgcttgcagagattagatttagtctggaaacaaatgggatcagcagtgtcgtttatcttagcgggtttaggccgagcttgaagacgtggctttcggctccaagtcgtgcccactacgttccaggccaaatttgctggaagacggcatttcatctaactttgctgccatgaacgttttcgtatcaagcaactagataaatttttgtagtttcaacctttagttagccgtcaaattgcgtatttccttgcaactcgtacatatcataatacataccgtgtttagccaacaattcatcatgagtgcctcgttcaataattttgccatgctttagaactaagatttggttagcatcctgaattgttgataatcgatgcgcaatcaccagcgaagttcgactctgactcatctttcttaaactaccttgaatcatgtcttcagtttctgtatcaatatgagcagttgcctcatccaaaatgagaatcttaggatcactcacaatggtacgagcaaatgaaatcaactggcgttgaccacccgaatattcagcaccacgttcaatcaccttgttatgataccccctaggcaactcttcaataaacttgtcagcttggacaaatcgtgctgcttgccggatatcatcatcgctaatctcatcattatacattcgaatatttgaagcaatatcgccataaaacaaaaacggctcttgtaaaactagcccaattttcttgcgtaattcctctggtgcatactcgcgaatgtcgtgtccatcaactaatatttgacccgattgaaattcgtaaaaacgcatcaacaaattaatcgtggaactcttgccacttccagtagaaccaactaacgctactgtctcccctggattcacagtgaaattaatatcattcaaaacatcgttttcaccatcgtaggaaaaagtgacatgcttaaactcaatttttccttcagtaattttcaaatctgattttacattttgtttaggtgcaaaactctgattgtccaatattcttaaaattcgggtactggcaaccagaccatcttggaaagtagacaaatagtccatcatggatgacataggattataaaagctatcgatgtaacttacaaacgcataaatcacaccagcagccacaggatttttgaacgcatcaattccaaacagcccaagtgcaataacaactcccaacgcatacatcaaattgataatcggattaagcagcaacgagttcatgcgaatcattgaaaaacgtgcgaataaatagtcattatttgttttttcaaattctgattcaattcgtttttcttggcgaaactgttgaataacaccaattcccacaagcgattcactgatcttagtattcaattgacttaggttttcgcgcattcgacgatacactgttgaactatatttttgataaaaccagataataaatactaaaaacggtagcaaggctaatgttgcccatgtgattttcacactagtcgtaaacatggcaaccaatgctgaagccataccaaaaacgccaacaatcaacgttaaaaataaagtccaaaagtcttgcaaactcatcgtatcattagtaactcgcgatacaattgaacctgctggagttgcatcaaaatagctcatacctaatttgtgtagtttctgaaaaagcaacacgcggacacgctccaaagttctttcagctcccattgcataaagaaacgtttggccaaattgaaaaacagcctgcaaaactgcacctaaaaagtaaagtccagcaaacaaaaacataattgaaagcggtgtcgatgtgtgaaccaagtaatgatccatataaaactgaattaagcgaggtaacaaaatgttaatcacactcacaatacccgcaaaaacaattgcaacgagaaattgcttcaaaaaaggctttgtgaacggcagcatccgtttgatcgtgtgaaactgctctttggtagtcattgtgtgcgaccaaattgattcttttttattctgcacttaagtcaccttctttttcgatttttgtttccatttgttgccgatggaacatgtcttgataccaaccaggttgactaaccaattgtgaatgggttcctctttggataattcttccattatctagaactaaaatttcattcgcattcattacactacttaaccgatgagccgcaataatagtagttttatctttcctttcttggcgaagttcctgtaaaatggcatgctcagtttctccatcaactgcagataaagcgtcatctaaaagaaggacttcgggattaataattaaagcgcgagcaattgccaaacgttgccgttggcctcctgatagtgatactccttgttccccaacttcagtatcaaattgatttggttgatctaaaatatccgcgtacagatcactcttttttgcggccgcaacaacttcatcatccgtcgcatcaaaatcaccaaatcgaatattgtttttgattgtatccgaaaataaaaagctttcttctggcacataacctaaagaaggtaagtatgaattcaaggcatagtccttgatattaattccgccaacggtgatagctcctttataatcatcaaactcgcgtaagatcaatttcatcaatgttgattttccagttccaactttcccaactagaccaattgtatttccagcgggaagtttaaagtgcacatcatttaaactgctattttcatctcccgggtatgtgaaagactgaatattaaagtccagatcaccagttgcccgtttttgaaccgcatgtttatcatcaataatgcttgacttagcgtggagtaataaattaacccggtcataacttgcatttccacgttccataatattgaacaagttaccaatcgcaaacattggccaaatcaacatcgtaatgtaggaaatgaaagaaaccaattgaccaatattaatcacattgtgaacaacaaatgaaccaccaagaaccaaagtaatcatgtaagaaatcccgattaaaacagttgtcattggattaaaaagtgcatccaacatattaacttttcgattaatttgaattgtttggtcaactaactttttgaaatcatcaatatcttcttggtcttgtccaagggatttgatgaccttaatccccatgatgctctcttgggttttattatttaatcgtgaaaatgctgcctgtgactttcggaaagcaatatggatcttggttcccaagtaaccggcactaatcgctaacaaaggaaatggaatcatagctaatagggttaagcgccaatcaaccaatgccatcattgcaataatggttgtaatcccagtaataattgaatccgcaaacgacaaaattccagaccctgctacttgctgaatggcctgtaaatcgttggttgcgtgggccattaaatcaccagttcggtgctcctgataaaaagtttgatccatttgcatataatggttaaataaccgacttcttagcgttttttcaaggcgtgcagctccgccaaaaatccgtgaccgccatgtgtaccggaaaatatattgtaaaaagcccacagcagcaagaattagtagtgaaattgttaaagaaaaacctgttaaacctctggtactgatttcttgaactaaattaccaatgatttttggcggaataacatttaaaaccgcgacaagcaagagaaaaataacgccaattaaataattccatttttctattttaaaaaaccaacccaattttcgaaaaattgacacgactgcccctcctatttataactagctaaaagtcatattccccaatttttggcaacaaaaaaaggacaaaaataatctttgtcctttatcattaataaaattgtttaaaactacttttgatgtttagcttggttctgcattgaattcatcatttgatgcaatttcttttgcgatggtttttgtcccatttgcaacatcatagtccgcaacatttcttcattgatcggaggattatttttaagataactttccatatatttacgagcagcaaaaaaaccaccgactgccccaagtaataacgcgataataacaattacaatccaaattccagttgacaaagtcctaacctcctaacaaatatgtatactaattcatagtacacaaaatatccacaaaataaaagaggtagtatcgatttatttctccatacctctcattttagcattaattttaaataagaaaagattaaaatgacattataaaacagaaaaattaaatttaatcatctcttaaaccctttttacgttgaactttttttactttttctggcgtaacttctttaccgctcttgtcaaagatacgcatcatttcgacttggctcttaaatccagctcggaaccgttttaaatatttttgtcgcaactctttacgttcgataatttctaaatccgttaatccttcagctttagccttgtgtgctaactcattaatccgtttgattaatttttgaaactcttcatcctctgccaatacaatcactcccgatttctttaaacataattctacactgttgcattaattttttcaaaaaattaaaccgaacatttgtttgaatacactaaggtcatatggtaaaatgaaaacaagaaaatgcgaggtgcgcaattatgtcaaaaacatctgaaagcaagcaagaggctgtactgcgatacatatatgacaacgtaaatgagaaaggctacccaccaactgtgcgtgaaattggtgaggcagtttcactttcctcgacatctacagttcacggccacattgaacggctgcaaaaaaaaggatttttacaaaaagatccaacaaaaccacgtgcgttagaaattactcctcttggtctcgaagaacttggagttagtgccacaccacataagattcccgtgcttggaacagttactgcaggtgtgccaattctagcagttgaagaagcaacagattttttcccgttgccaccagagtttgaacatgaagatggtgaattgttcatgttaacaattcgcggggaaagtatgattcaagctggcattttaaatggtgatcaagttattgtgcgcaaacagacttcagccgacaatggtgatatcgtcattgcaatgaccgatgaaaatgaagcaacctgcaagcggttcttcaaggaatctgatcacatccgtttgcaacctgaaaacgatacaatggctccaataattcttcaaaatgtcagcattcttggccgtgtcgttggcctctatcgtgatcaaatctattaaaagataaaaaagctcgagaattaatgattctcgcgctttttattttccaggaagataatctgtggctaaccaacgagcagtttcttgaatatttactgagccgttttgtaacgttcgtttatcaattggtacctcatcattaatgtttttaaccagttgaatatttttaggtaaattcgtcagatttggtgcaatcttacccgccaacacaattacctgacaagacggattccatttcaaacaagcacttgcaacaccaaacggaactttcccatttctggactgtgtatcaaaagacccctctccagttatgacataattagcatcctgacaaagtttctcgaattgactaatttctaatactttatcaatgccagaatccagttcagcgttaaaaaaagattttaacccataacttaatccaccagctccaccggttccccagtcattagcataatttgtatgcaattttttttggacaattttagacaaatgttttaaattattttcgagttcaatgacattttcgggtgtagcccctttttgagggccaaaaattttagaagctcctttttcccctaaaagcggattgccaacatcattcaaaacaaaaatcggtgggattgaggacatattttgtggcttaactatcttttcaagatccttcaacccaacgtttcctaattgaatagactcgccttgcccatctaaaaattgatagccaagtgccattgcagcaccaaccccaccatcattggttgcactaccgccaacacctataaaaatcttttcaggaccatactgcaaacaagctttaattagttggcctgtcccaaaagtagaagtcttcatggcatcaagttcagcagtttttaagtgttcaattccactcgctgatgccatatcgatgacagcagttttttgatccttagtcatcccaaattgagccttaattgatcttccaagcgcatcctcaacctctaatgtatgcgttgaaccacccagatgactcataagtgccaccattgttccctcaccaccatcagcaattggcaatggaacacaatctaaatttggtcgagcttttgttaatcctgccacaatatgctccgtggccactttggcagtcatactatttttgaaagaatccggcgccacaataatcttcatgataagcctcatttgtaattttctttgttaatattgactcggagtaaccgaattggtatgcaattctttgcttcaacaactgtattatactgaattaatgcagctttgtaacgctcacggtaattaacttgcagaatttcaattaccaactttgtccttaaaatattcataattttgccaatgaatggataatctaaatcatcacactttttacattttaccaacatcccaatcttgaatctagttagcatattaatcgccaccatttattagtatatcctcatgataacaataagtattgtcgtcaatcaattgacaagcctcgtttatacgattgtactttggtatggtttgcgcgataatataagaaaatgacctgtgagggggatatttatgttatttttgttcattatggcaatatttgcactcattttgtccattctaagactaagtatggttatccaaaatggcgaacgcttattttcaccgattctttttattgtggtctgtctaggcctaattattttcagtggctttaatttacctttctggcaaaaatcaaagtcatcaacgcagtccactgcaacttcaagttcagttcagactacttcaaaatctacaaagaagtttgcaagcacattttcaagtgcaggtgctaatgcgtttcctgacgagactaacaagcaaaaaaaagcagctcaatccgtcaaagaaaacaatattctagcctcactacaaaaaaattattctggaactggaactgtcactttcagtagaacggccaaagcgttttatgtaaaaccaacaaataaagattttgtgagctcgttgaaatctttaatcaaaacaccgtctaacgcaaaggacgcaaactttgatcaagttgtgaccaactttaaaaagctctccttatcaatcaaaaagaatttaggaagtaactatcaagtttcactaatgaatccaaataatacttcaaaacctattttgactgctaaagacggaacaatcacttataattattttcaataaaagtaatgtcatcaaaaaagatcgcccgataaaatatcaggcgactttttttaacgtttttgatattgacgctgttgatctttttgcccagccagataaaactttgcagagtctttttcataatctgtcacaaagtcagcatctgacaatggcatttgagacttaaacattttttcgtaatctggaattgataattcttcgcggttacttaaaacattggtgattgtggattcatgcagggcttgcttatagtttgattgcaccgtagctacataaaactcaccctctgcaccagatccgtaactgaataatccaattttttgagtttcatttaagctctcactattcactagtaatgataacaaactcaagtataaagagcccgtatacagattgcctacttggcgattaaaaacgcgagaatactcaaattcacgtaacaactgattggcatggctctcatccgtttctggcaagatcgcccttaaggccttcaaccccattttcgtataaggtaaatgaaaaactaaggcttgtaaatcagaaatctctagaccgtgttgtttttggtactgtgcgaatgtctgttggaaaaactcgatgtactgttttgaagaatacttaccatccactaatgcttctgttgcataaagtggtcgccaaaaatccatgatgtctgctacataatgggcagaaccgttctcaattgctaaaatgcgcggattagcactgataacaacggccattgccccaccaccttgagtaggttcaccggcattgtgcagtccatatcgagcaatatctgcccccactaccaaaacttggctatcaggatgagccaaaacatggtctttagctagctggatccccgccgtcatggcataacaggcctgtttcaactccacgctctgaattgtgttgggtaaccctaataaacgttgcagataaattgccgctgacttggaattatcaatcccagattcagtcccgaataaaataagatcaatttttttacgattatcatcgtttacaatttgatcggccgcatttgctgccatcgtaacggcatcttgagaatttggaataaccgcttgtttagtctgaccaatcccaattaaatatttgtcgggctcttcatttcgtgctcgcgctaattttgccatgtcgacataccatttgggtgtgtagaatccaattttatctattccaaccttcatcatcgttatcctccattttccgtatccataaatcgttgttacctattttagcatagataattctcttagctccaacttatcgcaagcgcgtttaggaaaccttaaaatgtcaaaagtcgcttgtaaaacgcttacttacagttttttggcgtaaaaaacttacgtgaagaaaaaaactatgatagtgtaatcaattgtctgttaaaaagagaaaaggagtttttagttatgtcagaaagttcggaaaataaacaagttgcaccgtcagcaactgtacctgttaaacatcctatgcttgccatgatgggtatgttaattggagggtttgtcggcatgttaagtgaaacatcccttaacattgcattgccaagcctgatgacgaagttaaacgttagtgttgggacaattcaatggttggtcacaggttacatgttgatcattgggattgtgctcccactttcaagtttactgaccaaatggttttcaacccgtcagttaatcattttcgggttaattgatttcattgttggttccatcatttcggctgtcgcacccacttttgcgatattgttaatcggccgaatgattcaaggaattgctactggtttggtcttaccattaatgtttacagttgccaccttgatcttcccaccgtataagttgggaactgcaatgggtttgattggtttagttattatgtttgccccagccattggtcctacattgtcaggaatcattttaggtgttctttcatggcggtggatcttttggttgtttgttccatttttactcattggaacattttttgccattaaatatttaccaaatgtaaacaacttaactaagccaaaaattgatatcttctcaattttattgtcaacaattggtttcggtggacttgtaactgctgtaagtatggcaagtaattatggatggggatcagcaactgttttaattacattagttgtgtcactattagtccttgccgcttacatctaccgacaattacattcagatgccccaattttaaactttcacgttttccaacggccaaactttagaattggtgccatcctggttatgctagatttcgggattattttatcttcaatgtacttacttcctatgttctggcaaaatggattagccatcgcagtcgcattgactgggatcgttatgctgccaggtggtgtcgcaaatgcgatattctctgcggtttctggccgtctttacgatcgtttcggtgcccgtttgctagccttacttggtttcttcatcgtcattattggtgttgtgatgttgttactagcaaattcaaattctgccgtttggtatgtcatccttgctcacattgtcattatgattggtgcccctgttgcgatgtcaccaactcaaacatttggattaaatgcattggacgcccgtactgcaggtgatggcagtaccattatgaatactttccaacaaattatcggtgctatctcaacagccgttgcgacaagtttgttaggacttggtcaacacgcttcatctgcgcctttaaattcacaaaacgcatttactaacggtgtacactatggtcttattttcccattggcactcgctgtaattgcattcttactttcatttacaatcaatgataaatcagaaagcaaataaattttataggtccaaactcaaaacgcttattcagtgaaaattctgaataagcgttttaattttttattatatctcgtaactaaaaaagaaacgcggttaaattcagcgtttcttaatcttactcataaggagagtacaggatttgaacctgcgcgccggtattagccggttcgccggatttcgagtccggtgcattaccactctgccaactctccagaactactgaataagtataccaaaaaatcgagaaattggcaaaaatggttattttacgatttaagcagaaaacatacgaaatatgcaaagcaatcatccctacttcgtaaattgaaaaccaaatactcctaaatctttaatcttattaaacattgactcaggtaatttgattgactcaatttcactggctgataaattcaaagacaggtttttctgctcaaataaatcaggattggcaaccaaagcagaacccaccgcaactaaatctaaaccatcggccagtccaactgccatcctttccaatgaattaaacgaaccagctgcaatcaaaggaacccgatgattcactagttttgaaattcgttgaataaacggttcagtatttgtactattatgctcatggtcacttaatgcatcccctaatgaaagatgtaaataactaacttgtttagcaaccaaattttcaataaggggttcagtatcatttaaactcaacccatcattttctcgttcttcgaggctaattcgatagccaatgatgaaggaatcgtccgcatacttcgcagcaacttttttgacttcatcaactacagccattgcgaaacgtaaccgattttttaaactaccgccccacttgtcatcacggcgattataatgcggtgacaaaaaattttggatcaaaaacccatgtgcaccgtgaatttcaacaccgttaaacccagcgtcaattgcacgtttggtggcagagccaaaatctctgataacctgtagtatttctgattcttccaaagctcgtggcgtttgctcaggtgcaaaagcagttttgtatgccaaaactgcactagcactgaccacatcctgatttgaaataaattctggtagagctttattgccagaatgatttaattgcaaaacagctttagcaccaccagccttgattgctgtggctaacttggtcaatccaggaataaaccgatctgcatacacggccaactcgtttgcaaaaccaacaccattttcttgaacgtgacttgaccctgtaattaccatgccaacacttttggcacgagcaccataataggcaacttctttttcagaaactgtttgatcatcatgactggaccacgttgtcattggtgacatcacaatatgattttttaaagttacctgattatttaaggaaaatgcttcttgtaattttaaattattcatttctatatcctcttttctgtattccaacatagaaaagaataaaccttcaagtcgtcttgaaggcaagtgttttatttcaatttttcggatatccgttccatttgtttagcatgttgctcataagttgcaatttttgtatcgagaaaatcatgcgtattttgtagtgcctgcatcttttgctctaacacgtgctgttgctcaatcaaaatttgtttgcgttgctcctcagtttgttcaccctgttgagctaaaagcgcatactcttttaatacgtcaattgaaatgtctgtttcacgcatgcattttgcaaaatttacccactctaaatcaatcgcatcataatcccgataaccactagaatttcgatgaacgggcggaattagtcccacttcctcatagtaccttaatgttggtgcgggtaaatcaaatttttcactaactgttcgaatattcacattaatcgacctccatttattaaaacaaaaaagccaacaaaattgtcagctttaacttaattgctgtcatcataataaaacaagatcagagagattcctaattattgaaataacattttacgttttataacaaacaagctggagaaaagcaactttttcccagcttgttcaaaaattaatcagaaacaactaccattgccttaattgttttacgattttgcatgtcttgataggcttggttaatatcatccaaaccgtatgtcttagtgaagactcgaccagggttaatattaccatcaagaacggccttaagcagaaattgtttatcgtaagtcgttactgaagccgaaccaccggcaactaagatattttgcgcaaatgttgaacctaaagcatggttattataatgtggaacacccacgtaaccaattcgaccaacattatgcagcactccgagtgcttgttcaatagcagcttgcgtgccaacacattcaagagcagcatccgcaccgccaccaagaatctcacgaactttggcaatacctacctcgccacgctcagcaacaacagcagtagctccggattggagtgccatttgttgacgatcttcgtgacgactcatcaaaacaatttgtgaagcaccacgcaattttgccgcaatcaccgcacattgatcaacggcgccgtcaccgatgacgaccactttatcgcccttttggacattggcacaacgcgccgcatgataaccagttggcatcacatcagctaaagttgtaagcgatttgatcattccttctgtgtaatcagatggttgtccaggaattttgatcaaagcccagttgccatactggaagcgaatatattctgattgaaaaccattggaccagttcgtcccaccttggtgacgatcacaagtcccatcaaagccagccagacaagcatcacattctccacaaccatgggtgaaaggtgcaatcacaaagtcacctggtttcacagttgtaattgccgagccaatttcttcaacaataccaatggcttcatgaccatcattaatcgaatgtgcttctttgttgtcaccatgcgcataagcccatagatcagaaccacaaacacaagctcgaacgactttgatgatcacgtcatcatcagcctgaagacttggtttgtcaacattttgtactgtcactaaaccggccttttcaaaaattgcagatttcataagtatcacactctgaacaatcgaacattcgtaagtaccgaattgctcgatgctcaattcctttcaaatttaatatacttctttaataacattaatttttacacctgtcaaaattttaaaaagttactcataaacaagagactaaactttcaaattaataccaaaatgttcaacaagtctcttagcatatttcatatgatcaaaactcattcttattttaatttaagatatgtgtttaaccttgaccatccttaaatgctggatataaagtcatcccaccatcaataaataatgtaatgcctgtcacataacttgattcgtcagaggccagccaagctgcgccggcggcaacctcttccggtgtaccaatgcgattcattggcaccattgaaaccgtttgatcatattgtgctttatcagcgaattttttagcattaattggcgtgttgatggcaccaggaccaatggcattgacgcggataccatccttggcgtattccatagcaattgtttgcgtgaataactttacgccaccttttgcagctgcgtaactagcaaatgttggccaaggaattcgttcatgaaccgatgacatattgatgatattaccttttttattgtgagctttgaaataagctaacgctgtcttcgatcccaagaagacaccagtttggtcaatggaaacgactttgttccaagcatctaatgaaagttcgtgggttgctgatttgatttccataccggcgttgttgacccagacatctaggtcgccgaagttatctagagcagcttgtaataatgcttgattaccttcttcagtagaaacatttgcttgcacgataacagctttaccaccatttgcaattacctggtcatcagccttttgtgccccaaccggatcgctattataattaacgacgacagccattttttcttgaccaaaacgggtagcaatcgcattcccaatgcctttagatccgccagtaataaccgcgacttttctctctaaatctgtatacattttaagtacccccttaaataactgttgtaataattgcaccaacgacaattaatactaacccaataacagtaaatctcagttcacgccgactcttcctttcatgtaagaacaccataccgccaacggtcgaaataacaacagacaattgtgaaacaacaaaagctgtatttacaccattatcatgaacagacagaatataagtgatcgctgcaaaagaaaaaatgatgccagctagtaagctttgccaactagccttttcccgtaacacttgcggttgtcgcgtaaaaacgatataaatcaacaccgccaacaccataccaaccgactctggcaagaaaattgctaaaccagaggccaccattgctttaggaattgagttatataccagaaaaccaatcgttgtcaaaattaacataatcaaagtactagtttgacttttttgttggtcaatttgaacaccatgatcatgaatagccgtcatgaaaataccgataattaacagtacaattccaacaacaccaagaattttagcgttaactgcgccccattcaccaaacaataacacgccaatcaatgatgtgccgatcaactgtaatccggtagaaattggcattgtctgagaaactccaattgcccgataagcgttgtattggcctaactgaccgataatccaaaacgcaccggctaatgctgccaatacaaaattactgactgagatttgtggacgcaaaataaagtagacaataacactcataagtaacgtaccaagcgcagttccaaaaatttgattcactggtcgcccgttgaccttagcaactgctagaggcaagattccccaagcaatagctggtagcaacatcataagaagactcacagccgcacctccatttattaattactcaactttctaagttcatactaataccttacagtaactttaagtcaagtattaaattaatcattactcaatttgacagtcaattcagactgggcgtcccgcaataatctgacaaaagttgactctaattcacctaagtaaatcatcttaaagggcgtaatatcagcgtcctgcaactgaaaagagaggacattccaatcctcataataatataatccaccagcatgaatttgtgccgttgttgtgacgccaacagttaccggctgaaatgctagtttagcatagtactcaatgtctccccgacgctgcaacgttaacgtttgtggaaactttttttgaattgctgcagctgtatgattcttctcgggttctaatggatatgcggattcattaaatgtgattttcattgtcaactgacctttctggttaaaacttatttaattgcttgattatcttagcaggtgtaactactacaatactagtcgccaggattttttgtttaacaacaccaccagtagtaacaccttgtaccgtacttaccttaattttttcagtttaagcttgcttttccggtaaaacttcatttaacagactcaaagccgtcaaactacgtggataaccaataaatggtaacaacacagtgacgactgaaagcagcgtttccttgctattacctacgttggcattagccgcaatatgacctttagcttgaggatcagcgccacccatggaaatcagcatggcaaaggtcaataattcccgtgtttttacgtccaaaccgttacgggtataaaaatcaccaaaacagttatcagctaaaaatgtagcgaaatgtttttgactggctggtgcggtttttaacatattatcaaccgtatccccaactattcctctgaccgttgccaaacctttttcataacgattatctggatctgttgttgcttgaccttcaagtggcaatttgatcccgcgttccgtcaatacttcattggttgcatgcaagaaatcaaagactttacctaaaccagcataaggtactgcctgataaacaatttccttagcttcaatcggtgttacgccaatatttaaagctccattcaacatggccttatattcattgacacattgcatagcgatcaatgaggctagggtcacctgcatgcgtaattttaaatctagatcctgatactttaaaatttcatcaaaagtgaaattatcgaaaacttcaataaattccggatcggtttgtttcagtgttgaaaccaagccaggaaataagtgttcatgattttgttgtgccgttttgctaattgccataattttgacctccaaaaattaatttgtttttaattcaaagctagcttatacccttgcagttactgtaaggcaacctttaattatctttttttaaataaacattcatccgcaaaattatttagccacattggctgaccgtcgccaactaataaaggcaaagaccaccgctaaaatgacaaataccagcgtattgagccagaacaagttttggatactggcaatgtgcaaactattttgtaacaacaaagcggtataaggcgataaacagccagctaagttgtaggcaatcaagatcagtgacgttgctaaagtattgccgctaccttctaaattgacggcgtttagaacccaagggaagaataagcgtgcgccgattccagtcaaaaagccaccaattactgttaaccaagtcgcattggacactgtaatggccaccattgccagcgttaatgcggtaaaggcaacaatcaaaatacgatccttcaaccaagtgaataaacggccaaatagtagcccaccaagcatggcaccaagacttaaggctaaaattacgtagctcgctgaagtcgcagtaccgtaacctgcactgaccatcaacgttggaaccttgatccccatgatcatgtaaaaagtgatcacaataaaggtcaaaatgagataaccaaaaattgctttcggtaaatgagaagactgctgcgccgttttttgttgtggctgcgccttaggaatacgtggcacaaacagtgcaaacattacaaatgctggtaccgtgatcacataggcccaaaacgacatatgccaattaaaacggactaattagcccgcgataaaggtgactaaaacgccacctaacccttcaaaagtactttgaaagcctaaagtttgtgaccgttctgacccttggaaaaagtagctgatgatactgaccaataaagaattgaacagccccaccccaaaaccaaatgccgcccgtgataacatcaataagggaaagctggtgatcataattggcgccaaaccagcaatcactgtaatagcaaccccgactaaaaccgtctgtttcaaaccaattttacgagcgacccagttacttaataaaattgcgatcaataaaaataatgatggaatcgtcgtcaataattcaatttgagctaaaggtacgctgggaaaagctttcgctaataccggaatattcgcattgattgccggtgccgaagctgtaatcaccgacaccaataaaatcgataatttagttaatacttgttgttgcttagtcatttgtaaccactcctaaccattttttaattgcttttgttgccgctgtataacaatatcgtgtaccgtataattagcgtatatggctgtactaccactaactcataaccatacctatttgtgaatattgagcttacgcttcggtattatctgctacgaaaaacataatcaatgtctgtgcactacgccatggtgctacatgagcattaatatttgtgacattgcaaataatggcacgacctttcaataaattcatcagtaattctaataaaaatgactaatggtcatattttggcattaagttaaccgccaatttctggcggttattttcactctttaactaaatacggtcctaataaactgggtaattgtagcgcgcaaaagcgtttaaccgtagcaactggatcaagtgtttccgacgtaatacaccaggttaaaattacgccatataattgcgtcaacaataattgagctaactgatgaaccggtgtcgcgattttcaattggttaaggtcaattagtttcatcaacaggcgctcaaaggattggacatcaaattgccactttgcattgttagcagatgaagcgctgatataacgtacccactggcgagccaacccgattttagaatctgcaatcacggtcataaaatcaactagataccgctggatattagaaagtggatcatcatttgttaactcggttgtccgatctgtaatcggggcaaaacgctgcttactcagttcaaaaatcaggtcttccttacggtcaaaataattgtaaaaggtgccctttgcaataccactggccttaacgatcgcatcaaccgaaatattctcgtaaccatgttgcacgatcaactgattagccgtactgatcaactttttccgtgtcgcgatcgcattatcttcacgttttcccacttcactcacctcaaaaattagtatacaatagtttagttcaaaaaaacaatgactaatagtcatatattataattgaatttttttccattgataacgtttataatcaaattttgcacagcttatgccacggtgagttacaattaagttataaaaatttaggacgagtgtaaaaatgaatattaaagaagctagcaaacaaactggcgtttcttctgctgccattcgctactatgaaaaagaactattaattcctgcaattgatcgtagtgacactggtaatcgtgaaattgatgcccgaattattcgccgtatcaattttgttaaaaagatgcgggcagccgggatgaccattgaaaatttacggcgtttcattgaattgtttgattcaaagaatgataccaataaggaacaaactgcattgttgaaagaacaattaaatgacatggaaaaaaagcgcgatgatctacaattggccattgaccatttacactacaaactggatcattactatgatcacgtagttgcgtcagaaaaagaattacaggacttagatcggcaacacaaagaacaggttgccaattctactaaaattaaatcaaatttttagcatttacgacctaggaaaacgaccagcaagacatctcaattttgctggtcgtttccttggtctacagtatcctttagtaactctaaactatatacttttacagtctttcaacttcattacaattgattgcaattgcctttacctacacaatgagcgtacaatgtgacggtaactataagcaagggagaacatcatgtatcagttattaacagattcagccgtcgatttaccttatcaacttctggctgataataatataaagtttgtgtccatgcacgtcacgattggtagctccgaatatacggatgatttagaacaccatttcaatttaactaacttttatcaaaaaattagtcagggtatcatgccatcaacaactcaaattaatatcggtcaatttattgaattttttaaaccttatgtaaaggccaatatacctatcttgtaccttggcttttcgtcaggcctaagtggtacgtttaataacgcccaacaggcaaagaaaatgttagtgcacgcctatccaaatgcacaaatctatctagttgattctctggcagcatgttgtggtgaaggcttgatgcttcttgacgcgattgatcggcaaaattcaggcatgaaaattgatgagctagctaactggctgattaataaccggttgcattaccgtcagtggtttaccgtggatgatcttaattatctatatcatggtggtcgagtttcgcgaacctcagcagctgtgggatcacttttacagatcaaaccagtgatggatgttgacacgcgtggtcatttacgaccagttaaaaaagttcggtctcgacggcggtcactagaagcccttgctgcaaataccgtcaaggaacttgaaaacaaatacgaccccagaattcttattgcaacaagtgctgatgataaggctgccagaattgttcggaatcatatttataagcttgtcccaaatgcacagattttgttagaacatattgggcctacaattgccagtcacactggtttgggctgtgttgcagttttttcatttgcaaaaacaaaacgtcaataataggaaaaaagactgtgaaagttttacaacttttcagtctttttttacctttacaaatcaatcagatcatgaatatcagaagtttctcgcaatttctctttgtactgatcgtgagtcgttggatccacaaaattggttccgggtgtaaaatgaatggcttccgtgccggcttccacagacgttttataataccattttttaaatcgcaaaaaatccaatcgagcttgcatttcttgaacctttttttctaaaacttgttcctcattatcaagataatcataacgtttttttaaagttccatcaccttgcaaacacatattaataaacttagcaatgtctttaacaggtaccccactcttcttcaagcactgtataacttccaaaaaattgaaatcattatccttaaattttcgtcttccagcttcatcacgatccacaaacggtaaaagcccctttttatcgtaaaaccgtaatgttgacggattagtaccaattttttcggcagcttctccaattgaatatctcaaaatattatctcactttcatttgacttaaacctctgtttaagtcgtattctaacctagaatcaagaaataaaaaagaggagatcttatttatgactaacaaaacttggcttattaccggaacttcaagtgggtttggtaaagctctagcaactttactagcaaaaaaaggtactgtgaatttagtcgcgactgcacgtaatattgaaaaattacactacttagatgaatttaatcatggtcagattcaaaaactaacattggatgtgacaaatcagcatgaaattcaagccgttgttgaaaaaacaaacaccatatttggcacaattgacgttttggttaacaacgctggtttaggctactttggtacttttgaagaaagtaatcgtaaaaccgttaaatatatgtttgctgttaatgtttggggattagttgatatgactcgtagtgttttacccactatgcgcaaacaaaaatcaggaattatcatcaacttttcctcaattggtggattattttcattcccaactctttcgttttatcatggctcaaagtatgccgtcgaaggtatcagtgaatcgttagccaaggaagttgccgactgcaatattaaagtaatgctaattgaaccgagtggctttcgtacagactgggctggccgatcttcaaagaaaattttgcccaaaattgccgattatcaacaatttaaagacttcatagaaaataataaaaatggggcgcatcacgaggctggtgatccaaacaaggctgccgaaattatttacgatcaggcaactaatcatataaatgatttgcctttacgcctccctcttggaaggtttgctaccgacactgcaataaaaaaatattcagacactttagcacaattcaagaaacaccatgatatttccgtatcggctgatcaaccagaataaaataaattaaaatttttaagaaagaggctcatattatgggaaaattagatggaaaagttgcgattattactggtgcaagctcaggttttggccggggaactgctcttgtttttgccgcagttggttgtaacctagttttgacagcacgaagaaaagatcgacttcaagaagttaccgacatgtgtaaaaagatgggtgttaaggctgtctactacgctggtgacgctagagaagaacaaacagcaaccaaaaccgttaagttagcaatacaaacctttggcaaaattgacattctggtaaacaatgctggaattggtcgtacgctttcaatcaccgataccacaatggcggattacgatttagtcatggataccaacgtaagaagtgcctttgccttcacaaaacaaaccgtccctacaatggtaaaacaacatgatggtcaaatcattatggtctcatctgtaactggagttgtgggccatgctgatgaaactgcctacacttgtagcaagttttccctgcgaggcctaggacaagcattagacaaagaattattagataaaggtatcagaacctgtgttttctatcctcatgctggtgccaccgaatttgaggttggctttggtagaaccaaagaaggtgttgctaaatctggctttttgacaccagaagatgttggccaggctttattaagtgtttgcacacaaactaaaaactcacgcatcgttgaattacgattagcatcaaataacgtcaagtattaaagcagaatgaactattgggtacagcgttctgtcctctggtttcaacccttgctaatagggtttacaaattaaataaggagaggaaagtttttttgaattctttcttctccttatttttttagccttttcgattctgctgagaacgcacactataaccccgtttcatgttactaacatccatcccgctatccttaaaaagaactcgcatttcatgcgccatttcttcttgccagttgggattagttcgtctttgatgcgcatacttttgcccaatttcacgttgttttttccgaaattcacgtaaatcaccacttgaaaactgcaaatacttatcctgattttttggtgaaagttgcgtaacttcttccaaatctgaatgatcatcccgattaaacacaaatgaaatcaaaggtaaggttaaataacaccacaaagcccactcaggcttaaaatacgccaagactaagacaataacattgattaatcctaagaaattgctatgattcaaatagattttatcaaatattttccgaatgtcattcatatcactgtatttttgatgaatgaccgcataactaactagcataaataatccatttacaataaacgtcaaaattccataagccatgaccgtgtgtcgattagtatccaccgtaattaatttagtgaacgttggtgtcagagatagaaaagctaagaaaataaattctaagataaaaacatgattgttcatagtctgtgcatcattaaataaaacggaatgctgataccagatatttgcgacaaaacaaaagctaatgaaaaaaattccgatggctttaccaaattgcagatattccgttaaagaatcatgttgaggcattggtaattccaataccataattgtaatgataattgcaataactgcatcgctgaacgcatcaagtcgttccttcagtttttccataacaaaaactcctcgtattaatccaataaaatgatacatcaaacctatccagaaaactagttgttacctaagtcaatttttttgtagaggccgggtcaaaaattatatttttattgcgtttcattatatcttccgaatattatttctaaaccaaaaaaaagcagattctttcgcctaattacgactaacaaaccaaagtacggatcatttgttagtctaagctatgctcagaatctaaccgcctttttccccactctctaataaaattagagtgatttaatctttttggctggcacaccaccaactaaaacattatcaggaatattcttggtcacaactgctccagcagcaataatcacattattaccaattgtcactcctggcataattgaaactttgccaccaatccaaacatcattaccaatcgacacgggagaggcttttgcaagatacatacggcggccttccgctgtcataggatgattaaccgtgtaaatatcaacatttggtccaatcataacattatggcccatattaactggcgcaatatcaaggattgtcaaattgtaattgcttagaaaatcttcaccaacatgaatattttttccataatcacaattaaaattggcttgaaccgagactctttttcctgtggatccaaaaatctctttgattttatttgtttgcgcctgtggatcggttgctgaaatttcattaaattcttggcacagttttgccgccctggcctttcgtttggcaacatcctcgtctaaaaaatagtattcttctccagccattaatttttctaattcagtcatatctttcacctcacagatcagaataccacttaaactaaggtttaagtctagcctattttgaaaagtcgtttctatcctttcaagcttgtttaaaataaaacaattttgagtttttaactttatttttgcaacaagaaattgttaaacttaagttgttccataaagatcaatgctaaaaaacagaaaggagagacttcgttatgaaaactattgatagcatcgcactgggattattgattgttggtggtctaaattggttattagttggactattcaactttgacttagtggcaactatttttggtggtcaaaccgccatcctctctaaaattatctacattgtcgttggaatttgtgcattatatgcattgaaattcttcccgctgattatgaatactgttaagcgtgaaggctaaaaagggctagattagtgaagtgcaaaaattagacgtttgcataaattttaagtaactacggcttgtttccgataatgaatcggcgataagccttttgtttttaaagaaatcctttcataattggccacaaattagtccttgggtacgttaaactaaatatcgtttgatagtgataaagatttttcttagttctatatctaaaatacataaattgattaccttcaaaaactcggcagttagatagctcagatcctccaattataacctattttgtctaatctcaatcccagttgaaatcttttctttacggcttcaattcctggatttaaattagttagcgattcagattgttgtggcatgactcagcctccccatcttcaataagtttgttttgaacctaatttaacctgtaaactgattttctacatattcgtgatataacggcaatgttttaatcaattcttggtgggtaccatgtccagtaacttcgccattttcaataaaatagatctggttagcatctacaatcgtactcaatcgatgtgcaatcacaagcgtggttcgattatgcataagtttttctaatgctttttgaaccatcatttccgattctgaatctaaacttgccgttgcttcatcaagcattaaaatctttggatctcgaagaaatgcccgtgcaatggcaatccgttgccgttgaccaccagagattttaataccccgttcgccaacttgggtatccaaccccttttccatttgagagacaaattccttggcatacgccatttcaaggacatgccaaagctgatcatcggaatattttccgttaagcccataagtcagattgtatcgaatgctgccactcattaattctgcattttgactaactaagccaatttgatttcgccaatcggttaaattgatatctgcaattgaaacgtcaccaatcttcatttcacctgaagttggtcgataataacgctctagcaagctaaagatagtcgatttaccacctccagaaggtcccgcaaatgcaacgaccgtgtttggtcttgccacaaacgatacatcttgaatagccgccttcccttttttataggcaaaattcaggtgactcacccttaaagatttcccctgcgcatctagtggctgtccttcattttgaacctcctcatcaatggttaagagctcttgaatacgggccgtcgggccactggctttagccatactggtgaaaaattgtcccatagtcgcaaatggaccaaccatttgaaccagatacataaaaaaagaaatcaaagtcccaaaactcatcgttccctgggcaacccgactagctccatatacgagaatcccaatcatcattcccatcatcaccatttgcatcactggtccagaaatagaatcataaatagcttctttcaacccaatattataaagtttctggattttttgatttccagcgttttgctcaaccgattcggcagtggaagctttgactaaccgaatctcacctagtgtttcgctaacttcaccattaaaatctgccaaagtgtcttgacgcgcatgggaaatttttcgtgcttgattcgcaattggcataacgcacaaaataaccaaaggcacaccaataaacataattaaagtcattttccagtccattattagcattaaaactaatgctccaactaattgaagaattgaggtcaccatgttgggaaccgaattagcgagtaaatccttaacctgtgaagtatcatttaccaccctagaagaaatctcaccagatttggtttcgtcaaaatagtttactggtagcaccagaattttacgccataaaaactgccgcaggttgttcacaacattttcgccgaagaatcctaaaacagcacctgatccagaactaacgagtgcactcaaaacaaacaggacaatcgtccaaacaactaattgcatgttaattccactttgcaactgattgatcaatcgttgggcaacttttggcacaatcaattgcatcccagttgcaattaggccaagaaatagccctagccctagttgccaaaaccgtggtttgattttagcaattaattgcacaaaatttttaaaattaaatttttgagagtgtcccacaaggtttgtattcatgtttcgcattttgttatatctccatttatatagtaattttaatcgtgattgtaaaaatcaaaaccgtgcggaaatctaggatgacccattcccttaaagcttcgtctcgtgttaagaaaatcattacgacgttcttcccactttggttccttactttttaagtcactaactaatttttttaaagaatcacttagctgttgctggtcattgtctgacaatgattcaaataatgaatcaaagaaatcgtttttaagttgccgcgacttgatgatcgattcacgaccttcatcagtgagtgaaataaaagtaacccgtttatcatcaggtgactccgcttttttgaccatgccactttcttccaacttgctgactagcacactggcagaactaggacgaatatctaattcctctacaatctgtgagttcgttaattgatctttctccaacaagagccgcatgacacgctgttgtcctcgttgattaaattgtggattattctcttcttgtgtgcttctaattgccgctgcaacaaatactttttgttgaaataaatggccaaataaatttaataactcttgtgtattttttttcatgttcaataccttcttttttatttagttagtttgtgttaccaattaactaacaaaatacagtctaactacttagttagtacatgtcaacaataaactaactaataaaaatattttttcatattaaacgatcgccaattggatttgctgtacacaacatattaggatacactaatatgtaggagatgatcccatgactattacccaacagaaattgattcatgccttaaataatgaagttagattagcaattctagaaactttaaaatcgggttccaaaaacgtaactgagttgacggaaaaaattaattctagtcaatctaatatttctcaacatttagcctgccttcgtgactgcaaactaattacccagaatcggcgcggaaaatattactattatcaattagctactccagaaatcacccatcttttagccgaaatggatttggttattaaaagtttgaactggaaaaacaacgaggtttcggtggcttgcaaaagtgacatgccctagtccacatgaaaggaattttgaatgttaacattaattttttctggagtgactgcatacatttcaaccagcattgattatttagttattttaatgctcattttttgccgagcaagttcaaaaaatgaacggttaactgtgtatctcggtgatttacttggaacctccgttttagtaataatttctcttattctagcctttgtcctgcattttattcccgctacttggctgcttggaattttgggacttattccaataattatgggcatgaaattaatagtaaatggcgaagaaaatacagatacagttgtgaatcaaaaactgaacgcacggcgaggttttctcttaaatgtagccatgatcaccattgccacatgcggtgctgataacattggtatttatgtgcctttctttgtgacgttgtcagtttcaggtatactgatcgtattactcacatttactgtaatgctaactattttttgttatcttggctatttgctggtaaaagttcccgttattgccaaaagtttagaaaagtatggccgatggattactgcagctgtatatattctgcttggtctttacatcatgtttgaaagcggtacttttaataagctgttctcaattttgtaactatttttagtgagattaaaactgtcacctaggtatgtacaaaactgccttgatggcttttttgatgtcaattcgcacattgaatttttaagcgtacctaaaagtgataaggctctttacttattttttgtaagaatgaatacttgcttcatcaaattaataattaatttacctgccaaggaggtaaacattatgaataaaaacttaattggactacatcatataacagcaattacttccagcgcaccaaaagtattcaatttcatgatcgaaattttagggttacatttaattaagaaaacggtaaaccaagacgatattcgcacctatcatttatattttacagatgacatggtcaaagccggcactgatataacgttctttgattttctttgaattcctaaaggtaaacggggtaaaaatggaattacccggatcggtttccgcggtcctaacgataaagcattgaagtggaggcaagaccgtctcgatgaatttgaaattagccatgatgaaagcaaaacgcgttttggtgccaaatatttttatttttacgattttgatgatcaacaataccaattagtttccgaagaaaaaccatggtgttgctggaggagatccttatcgacacagcccagtgcccggagagtacgcaattcgtggtggtttaggaccttcgtttggcaccatagactatcccgaaaaactaaatcaagttcttaccgaagttatgagctttactaaaatagccgaagaaataggtaaaactttgtatgagttacacgacggagatcacggttcgcaaatcatcactgagacaagtgtcgtgctccccgatcaattccaagggtttggtaccgttcatcatctggatttgttgatcgcttttactttaaatcagaatattttcgtcctggccgaggcatccttattagaaagatcttgtgtatgaatatggagcatatttgccaactctcttatataatgaaagtaaacttacactattctcttacctagatggcaagtaactcatttcttacgcactagtaattttgataccaataatgctgacaactagcaacccaacaaatagccaagttaatggtgttaaactatcatgaaataaaataactcctatcacaatactaccaaccgcaccaatccccgtccaaattggatatgccaaactgagcggtaatattttcgtgactctagcgagaaagtaaaaacttaataacattccaattacggttgcaatggtaaaaccaactttagtgaatccctgactaaatttcatggttgtcgcccagaccgtttcaaaaagtccagcaattaataattctatccaaatcatattttccctccaaaaaacgcaaccctaaacttcttcaattgaccttacgaagtttaaaattgcgtttctgcacccggtggcacttttattttatttgtgtattcagtgtaacatgtcagccgcctaatcaaaaataaattgttacgctaaaatttgtttgtagagccaaaaaccaattccaaaggtcaaaatgtcggcaactggttgagccgcaatcacaccattataaccaaatatccctgctaacaagataatgactactgcaaaaacgattccttgacgtgaaatggacatcactaacgctcccatcgctttgccggctgattgaaagatcgttgtaaacaccaaaacggccccaataaacggggaagtaatcaaaagtaaacgcaacatgaccgtccccattttgataattgtagtattatgcatgaacagcgccatcaactgtggtgcaaaaatcatcaaaatagccgcacagattaaagcgtacacaacttcaaccataaaatcgaatcttaccactgctttaaaacgagcctgatcaccagaaccataattgtaaccaattaatggctgagcaccaaaagcaaatcccaccataattagcatcacaaccatgtatatttttaaaacaattcccatggccgcaattgcagttgccccataaggcgctaagtaattgtttaacagcatcactccaaaactctgcataaaattagttaaagaggctggaatcccaatacttaaaacatcctgaactactttttggggaatatgaatctttttaattgaaagggaaagaatctgacaatcttttaccatgaaatataccaatagcgaagtattcagaatatacccaattacgttggctagcccaacacctagtgctccccaatgaaagacaaaaagaaaaagaggatccaaaacaattgtcaaaatggtcccagaaagtgtagccaccattgatttggtggctaaaccttccgttcggataatgttacctggaactaatgaaacaatgatgaaaactgatcctaacgcaagcattcggtaaaaatcggccgcatattgataagtttgggaggtcacacccattaaaccaaggataggacgttcaaaaatcagcattagaattgttaacacaagactaaacaggatagagttgtaaaaacaaaagctgcttagatgagcactatcttcgtgctgttttttaccaagcattctggaaattgccgcactcccacctaaaccgaaaatatcgccaatggcaagcataaacgaaaataaaggcgttcctaaagcaattcccgcaactaaatttgcattaccagtttgagccacaaagaaagtatcggctaaattatatatcatgcttgcaaccatccctaaaacaactggaagtgcaagtttcatataaaccttaggtattggtgcatgcgcaaataaatagtctaaattcataaattcttccccaatttcataaaaaaatccccagcaaaattagctcattaccttgctaactgtcttggggtcacttattttactgcatttttcagattaacacccaatttttcgtttgtccattatttttgaaaccgtttcaaatgcggttaatgctggaatatgttaaatttagagtgcaaaatttgcaaacccagagggaggtttaacatgaacaataaccgcttatttcaaatgccgtttagtaaaatttatgctttgtatagtcagaaaatcggaaaaaagggacgtcaacaatctgaacttgatgccgttattttttggctaactggttataatcccaatacgctccagcatgtccttgattccgacattcctttaaaaagcttttttgaagactcaccaaatttcaatcaaaatgctaagttaattactggattaatttgtgggtatcgtgtggaaaatattgaagatcccttgcttcaaaaaattcgttatcttgataagcttgtcgatgaacttgccaaaggtagaaagctagacactgttttgcggaaatgattttcaaatttgaatttggtgaaatttaattggataatcgcattcaaatattgtagcatgggaacggagccttaaaagcaaaatcacaagaattgagttgaatgacatgaacacaaatgttttttcgaattatcgcaactggctggaaacacaaaaaatacctaaagggaagaaagccgttttactttctgctttaaccctcttcgcagaatttggctttaatggcacttcaactgctaagattgctcaaactgcaggcgttagtcagggtacaatttttaaatatttcaaaaccaaacaagatctactaatctcaattttgcaaccaatcatccaaaacttctttccggtttatcgcgatgattttttggccgaatggcagaattttaatactctgcgtgaattagttcattttatcattcatgatcgctatcgtttcctaaaagaaaattcagatgcatttacaattcttttgtccgaaatgttgaccaaccaaacgattcgtcggttatttcaaaaaattcttcagtcttctaaatcaatcttcgtcaagcaatttcaaaaaaaactccttcaaaatggtgtgcgcaaggatctagacagtttggccgtctttcgaacccttttgggtcaactgctcacctactttttacagcagaaatttgccccccagattaaggttaatgaagaaaacgatctaaaagagattgaagatcaaattatttgcgcaatcagcgaccaaaaaagagaagccaattgacttctcttttcattttgtattttttattttcctaaatacttgatgacagattttcctgccaaacgtcccgaattccaggcaaacgcacaactaataccttccaatgttggataagaagtgtcatacataccacttgcatcattaccagcaacgtaagcacccttaattggctgcttatttacttttaaggcttccattttggcatttgtttcaattccaccaattgtacctaaggaagttgaacgggctttaagggcataaaacggaccctttcgaatcgagaaacgcagataatcagatgatttataaaaatcaggatcttcttttttgtcgacatgctcattgtactgtttaatcgtgttttcaaaatccagttccggcacgtgcaattgctgcgccaaatcttgtaacgactccgcacgccacccggcttctttttgaatcgcttcttccaaatcagcatcaatttgtggaaatgggccgactttatgggtcatcacttgatgatctaagctcttaaaagtgcgttcaaacgaatctgtccaatcaagtgattgcgctgaaatatagtcaacaaactgttgatctagaataatgtaatagtagccgcctgccgtataggttgcgttgccccataaagcaaaatcgtagcagacactttcatctacaaatcggttaccagcgctatcaacccacaaaaatggtaaatttgttagtgaaaaaattgtcccgttgtgccatttatgattttgtggtgaaatcaccgaagccgcatgattttcaaacacccccatatggcgagtgtctgcccctaactcggccagcattttgataccatcaccagttgccttacgttctcccatgctatatagattatcaggatttatggctaaatattctttgatgagatccggattgccaataaaaccaccatcagccacgaccactgcggaacaatcaatcacaaaatcgtgtttatcttggtgaacctgaacacctactatgttgccatccttttgaataatcttagtacctgctgttttaagtaagagttgcccaccatgatccttaaacctgtggatgaggcgatcaaacgcagcaaatttatcaatgtattggtggtaaacctttggatgttgttgatggacctcttgtgtattatttacaagttcagtttttaatcctcgctcatcaagccagtcaatggtagatgctgattcctttaggatagcttttgttaaattcaaattactgcgataatgggtgtagctcaccagctcttgataggcttgtttgagggaatattgcacacccgctgccctttgttgactactttcaactgcaaacagtccctgagcaccaaacatcccagcagcaccagcgccaacaaccacaacatccgcttccatgatttaaaaatctccttttcaaaagcaattcagcaatttctttttcgatacatctaattaagtttaccaaagttcaatgatgaaagcgattaattacaacccacctggtcttgaaacagttgataaagtcagaaaatcaaggcaaaccgacactaaaaaagccttaatctagagagtgaatgaacagcttcactcccaaactatcaagacttttttaaatctagttttaatacatggctgcatcaatattcatgattttccagtcatcagcaaatttttctacgtgcaaggtcaacttaagtggccatatatttcgcccaccatgaatactagcatcgactcggctttgaccaattagatctgcctgatgatcatttttcatctgaacttctacattttcttcagttgaagaaaaatagttcatttgttttgtatcaatgtcttgtaaccatttttgtttactctggaccattcccgtcatatggactaaatggaaattagcatctagtaatacgcctaatttcttagtatctccggccaccatataacgattatggtctcggtataattggacaattcgtgcttcttcatcattacccatctattctgcccccctgaaatatccttattgacaaggtccgccatgcaaagtctataaaatagttcaattgattttgactttccgtttcaaaaaattagaaattttctgaccagtccacaaccgctttttcagctgtatcccaatcgctgccggtcaagcccaaaccctttaccacctgagacgttccaacaagatgcttgaaatctttttcataggaatcagccgaacctgtatccgtataaaaaggcgctaatttggtttttgaaggtgtaatttgttgcaagaaactacgaactggcgttgaaacttcaccagaccaaactggcccaccaaccaaaactaaatcataattacttacatctggcaactcgccaaccagttttggtaattaatttgtttccaactgttttttggcccgatctgaagtatcaaacatatcagtcgaaaatgtaccatctgctaccttcattgcaaagacttttccatttgtcactctttgaataatttttgccagtctctcagtattaccagaccaagaataataggcaattaacatcttttttgccatcttttgtctcctaaatgtttttaacactctaaccgagttatcaatatcctaaacctgttacttacgattaatccccaagctatctcgtgagcctaatttttcatcatgagctaaacgcacaaccaagtccgcaatactctttcttgatacatcgtggccaccaaatggctcacctttttttgtcacttcataacttgtatcattaccattatcgaaccatcctggtcgaataattgtgtagtttaaatcagaagcctcgatcacatctgctgcatctcgataattctgtaataccggattagaagccaaattgccactagcacccacggaagcgggaatttcattataaattcccatcgaagtaataaacaaaaggcgttttacgtccgaatgatccattgcattcaccaaggaagaggccattgaacgtaagttaccacttaaagcagcgaatacggcatcttgtcccttcaaagcctcaagtaaagtacttgtatctgccacactgccagttaccgccgtttcgcgctcctcatttatgcgtcctaaacgacgagtatttctcgccattaaagttaatttatcggttgtattctctaaaaagtaatttcttgtgacactaccaactgaaccagttgcaccaataattaaaatatttgccattttaaatttctcctctttactttataaaaactaaataacctgattttgtggatctaataccaacgattcagataacaaaatttcactaaataaatcataaatatattcggaattaaccatgtgatttttagcaagatcataaagaaaattacgttcttcatcaaatgcttgcatcaaggcccgtcgttgttccacactttggatacttgtcaaagtggacttgtccgtggtcacagaacgccattgattgaaaaatgcttttaacgtatttttttgcacctgatcacgcaaatcataaatcacgatttcgcgtactttgttactcaaagtcatcgtttccacatgctgaacgccaacaattaccatttcatttcgtaagatctttaactgagttgtcttatttaaagtatctgcatctaaaggaagaattactttaaaaacgatcgtcggaattaacatgctcaaaataatcacaaccgtttcaataagaactatttcgttaaaaagagatcgcgaaaccccattacttaacacagaaaatgtcatggctaacgtcactgtcccatgaaccccgccaagggcaaataacagtgcagatctgtttgtccgatccgaaataaaaaaacgaccatagataaaacgcacaatcaataataaaacgtaaaccagaacgcctatcgccaaccaacgcaaggaaatcccaatactgcggcgctgttcaaaaataattctctccaaactaagtcccaacactacaaagacaaaactgtttaacacactattggaaaaattaaccagctgtaaacccagatgcatctggcgtggtgatgaaaatccactccgcgttgtttcgctattatgaatcaatccagcagtcacgaccgcaataattccagaaacgcctacttcttctgcaatgaaatagatacaaaatggcgttaataggtaaattagggtttgcgatgaaatcacattgactgatgatcgaactaaaaattgacgaaaggccatcacaatcaagcttagaattccgcccaaaataattccaccgcctgctgaaaataaaaacaataacacattttttccaaacgcgacctgaccggtttgtaaccagaggaaggcagcttgcaagagaattattccggtcgcatcattaaataaagattctaactttaaactttttcttatcccactttgaatggttcgtccctcaatcactgaatcaaaagctgtggcatcagttggagtactgatggcagtcacgatcaatgccaacggaatcgccaaagcaaacacttgatgaaccacaattgccactataattgccgaaacggctgctaaacctacagccgttcccaaaatattattaatcttttttcttaccaacaaagccggtgtggcctggccttcgaaaaacaataatggtgcaataataaaaatcataaaaattttatcatcaaagctcaaaatcaaatgatttgtaaatggaattattcccaaaataattcccatgaccaaattaatatacgtacttgacacatgactgacagttttggcaataatatcgctaattgcaacagcaatcagaacaacaaaagacgacaacattaatgacattcaacaaacttcctttcggttctcaaaccaggctaaattccaccttcagtatatcaagttttaaactattttagaaaaatttgccaaaaatcatcaatttaatccaaatcgttattcaaatttagcagtggtctactcgccatctggaaaatcagttgatgctgccaaatccttttgttttttgtaatcatccaatcgctttgttagcacatcaattgtgttttgtaaggccgctgatccaagcatcatccgtaaaggagcaggattttgatctacactctcaataattcgagttgccattcgtgctggatctccaggtgctaaaccattagcagggtccaacattttttcaaatgaacgagccggatttcccttatatgctggcattgctttggctacttgagcacttccatatctaaattccgtacgagcaccacccggctctacgattgtaacaccaatgttgaaaggtgctacctcttgggccactgattctgcaaatccttcaatcccaaattttgatgcatgatacattgagtttcctggaaaagcaacttgaccaccatatgaagaaatttgaataattcttccatgtttttgctcgcgcatttttggtaaaattgaacgaatcatttggatcgatcccaataaatctgttgaaaggattttattgacttcttcatcactaagctcttctgctgcaccaaacaatccatacccagcattattaactaacacatcaattgtggcatgttctttagaaactttgctgaccacattatgaatggcggttacatcagtaacatccaacttttcataagaaaatgtctcaggatactgagcaattaaatccttaatttttgccgcatttctaaccgtcccaatgactgtatttccagctgctaacaattgttttgttaattctaatccaaatccgctacttacgcctgtaattaaccatgttttactcatcataaatttccacctatcttttaatattttttacttatcctgatccaatttttcctgatgctgccgttcaagggtgcgcaattcttcttcactcgcttgtacatgatcataaaaatgattcaatttaaaatgcaaatgatcaatagcagcctgaagatcatcacgtttttcttctatttcggccatttgctcgtttaataaagcaatttgttcttttgtattgtcttcttgattatcaaataattgaatgtaccggcggagattttcaatactcatccctgccgctcgcatttgtttcacaaaattaatgcggcgaataattcgttcatcaatttcacgattaccagcctcgcttcgatcaatcgccggaattaaagtttccttttcgtaatacctaattgtggccgaagaaacacctgttttttcactggcttctttaatgttcattttaatcctccttttaaattgattcttatgttcttaagaactgtctaaagcataactcttaaagtgcacttgaagacaagccccaaaacttgattttttgaatttttttaaacaactgcgctttagttcaattgtttaatgacctttgctggagttcctaccgcaatacaattatcaggaatatctttagttacaactgctccagtcccaataattgagttttctccaattgttaccccaggtaaaatgctcacacgggcaccaatccaagcatttttcttaatatgaatttcaccagttttaatcactcgaatatttttgggctcatggttgaccgtataaaaaccaacacccggtcccatcatgacaccatcatcaatggtaatagtgccaactgacatcatagttaaactatgattagcataaacatttttacccaagtttactcgattagcacaatctacatgaaatggtggcgtaaaataagtgccatctttcatttgaccatgaaacatttcgttctctagatcttttaaattctgctttttagcaggatctgtcatattaattaaatgacaataatgatcatcacgatcaatttcaccatgaacttccttttgatactgttcgtttcgaatatcgaaagattttccgtttcttaattcttcaaaaacactcataataacgcttctttctattttaaaatcaatttattgttaatttaatttttattcttctttggcacaatcataataaacgtaaggattaaagcaatcacaagaaaagcaaagcctcctcgtagtgcccagtctgttcggattaccaagctgttggagtttgcaaccacagaactcaaaacgactaaaagtgctaagcccaatgagccacctacttgatgggccacattcacaactcctgatgctgcaccagcatctcttgcattaatctgagcaattcctgcagttgttaaaggactcaaaactgccccttgacctgccccaattaagatcatcggtaaagcaattgcaagcacataattactgccattgccggcaaaactcggccaaaacatgccaataattgttaacactaagcctccaacaagtgtcatcccattaccaaatttagcggttagttttgaaacctgcagtgcactaataaagttagcaattgtcattgggaagaaacctagaccagccatcaagggtgaaaagccataaacttcttgtaaaaattgagtgatgaagaaccaagaggccatcatggcaccgaggaataacattcgggctaaataagcaccagcccgttcagaattcttaaaaactcttaatggcatgattggttgagcaactttggcttctcgccaaataaacagacccaataaaataacggccgcaataatccaatcccaagctgtagaactttcagaaactaacaaaatcccataaactaaactaatcataccgagcagtgacagcaaagacccaataccatcaaaagatcctttttgtgacttgcttgaccgaactgcttttgtcgcccagataaacattacaatggcaattggcacatttacgaaaaatgcatatcgccaactcaataaacttgcgaacaaaccgccgattactaatccaagacttgcaccaattccagcaacggccccgtagtcggcaactgctctgattcgtttttcccctgcaggaatactatccatcaataaggctaaagttgatggtgccaaggctgcagcaccagcgccctgaaagccacgagcaatgattaaccacattggactatttgctaagcctactagtaaagaacctaatccaaagatgactagtccaaaattaaaaacatgttttcgcccaataatgtcacctaaacgaccacctaggagtaataagccaccgaaaataattgtgtacgcattttgtacgcaggttaaattggcggttgataaattcaaatcagtctggatttttggtaatgccgtaatcacaactgaaacatccagaaccgtcataaaataactcaccaagacgatcgataaaattgaaaattcgtattttgtaaatttactttgcatgtttgcatctcctcatattcttgtttgactacaattaagaagtatagagggttgtagtaactgcaaggcaagccttttttcaaaaaagtttcattttttctgaaagaaaccgaagctcaggattttagacaagaaaaaaagccgaataatgattattattcggccattttatacacaattttcaagttttatctaaaatgccatgtaacagaagtatctttcatttttcgcattgcatccatatcagcatcagatatctcaaagttcagttttgtattgctttcaatatgcgtcttacgagtggctttgggaagcggcacaatcccattttgaatacagaattgaattgcgaattgaggtaagtcaacgtcatactttttcgccattgtctttagacctttattgtttaataaagctcccgtggctagtggagaataggcttcaactaaaatattatgactctgggcatacttggtaatggcgtcttccgtatatcccacatagtactgaatttgatcaaccattggtttaatctctgaatgattaagaatattacttaaatcattcgcgtcaaaatttgaaacgccaatagctttagctctaccagatttgtaaatttcttccattgccttccaaacatcacggttttccaaatcataattgccgcctgtctgactccaaggttgaggagcatgaacaagatacagatcaacgtactctaaatcaagattacttaatgaagtgttaaaatcatttaaagtcccttggtaagacttagtttcagccggtaacttcgttgtgacaaagacatcatcacgcttcataccagactccttaactgcttcacctacttgtttttcgtttccataaacaagtgcagtatcaatgtgccgatagcctacacttaaagcatctaaaactgcttgttttgtttgagaagctgggatttgccatgtcccaaatcccacttttggaatcgttgtgccattagttaagttaaaagtatctgttaattttgtcattttttaccttctttatataacatagagtgcttactgtttgtcagtattgtttactaaataacgtagccaaacagtattgccttttgtttctacaccttttaaagtaaatgaaacgggtgttgctttggacaatccttcacgagcttcgaataaacttggcgttttgctcgatccatctgctgccggtgtcaaaaccaaacttatctcatcacacaatccctgctgaatgaaagaccaatttaaaacgcccccaccacctaacatgacggtttccatatgaaataaattcttcaacttgtcgagagctagtttagcatccagtttatccttacctgaaataatatacggtatatttttatgccttaaaaacgctttataggcattactagcttgacccgtaagaacttctaagacttgtgcatgggtcgtttgataaactaattcatttgactgccaagctaagcggccatgaggatcaatagaaatataatacttgtcaaacttagtcggaataacaaagtccccagccggaacctgaggcgcattttgatcaaggtccggttttttataaaatgtaaaattatcatctgtagtggttcgccctgaaagccagccctgatgttgataatagccatttttttcaaatgctaaatgataaaatagttgaccaggttctggtcctgctgccccatgataaggcccactaatctttccatttaacgaagttgccatatgacaaaaaatataaggtcggtccatttttatttttctccttttatattaaagctttgaaaactactaattgctattttgaaaacacttaataaaacgagggcttatcccattctgtatctggttctacaacaccaatattttgcttactatatttagttggctcctgaataatttcggtaactagtttagcaattgcctgtcgtgtaacttgagtaccttttagtggctcgcccttgggaacaatttcaaatgcttcgttaccatcctgatcatacaaccaagtcatccgcaaaaaagtatagttcaacccactgttatcaatcacggcagcagcattcttgtaaattgtatagtctcccatcatgttggcattccattcaccaaatttaccggcaacttcatcataaataccaagcccacccgcaacaattagccgctctccgccaacttttttcatgatttttacgaccaatcgattggtcttctcaaactgagaagttgccaaatagacaatgtcttgcccagtaattgcgcgcacaagctcatcactattacgccagttacctttgataattgtgacgttgttagtcttctgatattttttcaagacttgtacatgacttgaaaataacgttaattgaatttcaggaaaagacaataatcttggaatcaaatactgacttatttggctggaagctcctaataaaacgacttttttcatgatgtatcctccatatttacaatttaagctttacaaatccagtttaaatgcaactttgttatacgtctaatgcttaatctgaatcaatctatgctcataaggctgatctgtcgttcaattagtacgtaaatccaataaaaaacttttcacaaataagaaaagttttcgtctataccttcattttatttattaatttttgctatccattgtgcaacttgtaacttagaccgatcaactttatttccatcaacaaccaacgcttgggtaaaagtgttttggctggcgccttgttcgcgcaaaatttcttgaatttgttgaacactgtcgccttggccatacccaccttcactcataaatggcgcaattcttttacccgaaagcagttgaccaaaagttgttaaaaatgagttcattgggtgtgataaatgcattgcccaaatctgataacctaaaaaaattgtgtcatactgacttaaatccggtagttgcatattcagctctggataattattattttctcgttccagatttgcgcgttccagtgttttctgataaacaccagggtagggattttttacgacaacctctaaaatatcagctgaagttttttcttcgatcataccggcaagcaattcagtacttcccgaccgtgaaaaataaataataagttgttttgcatccttagttagtttccgaactggttgatttttgttgtttgtatcttgaccatcagatggtgtcccataaccattttgccattcaccgtttgttcttcctaattgcggtgcatatattggctggccgtcaattttaccaacaactttttgcgtcgatccttgtttttttatttgcaaattttattcctccattttctgaaattcatgtccactaaacccacacattatcaaactaactttttattatggaccttatatctcactccaaggcaatatctattagttacatatttgtgcagaaacaagaaaagagcaacaaattttccctagagaaatttactactctttaaaagaacttcttctatttaataaaccggacgatctgaaccctgagttgctggatcggcaattcccaaactatcttttgatccaaaagttggatcagccacaatcttcaagaccacatcagcaatactttgccgtgatcctgagacaccattgtactggtcatttttgtgtgtcaccacatacttcacttcatcacgatcattcaaccatggtaagcgcaacgttgtgtaatctaaccctgattcgtcaagaagtttatctgaattaattgcggccggtaatccactcatgacactttgacgattccagcgaccaaactcaccaggaacttcatcatataatcccaaaatatttgtaaagacaactcgttgcacattattggccttcattgctgcaatcacatttttagtccacgcattgttgctagtatgatcaacaactgctacaaagaccatatcttgtccagaaactgccttgttcacatcattttcgttatcaagactaccttcaaccacagtcacacgtgaattatttgccaaattactcaaccgagaactattccttaaaaataaggttagttcgacatctttaaaagccgattcacttaatacacggtcttcaacgattcgggcaatctgtccatttgctgccataattaataatttcatttttgttttctcctcgtattttatttattgaatgtttccgtcatatgctaatttttctctttcataattaagtgtatgatcttcaaaatgatcaatcttataatcaagatacttaatcgtcttttcaattttcttacgttgatcttctaaatcttgccgttgatcaaccaacaatgacttacgtgatccggccgtttgtttcccttcacgatacaacttcacaaactcaattagggcttcaatcgacatgccagcatttcgtaaagctttgatatagaaaacccagttcatgtcgcgttcactatactcacggtaaccactgtcatttcgtttaatttctggtaacaatcctaaccgctcccaataacggagcgtatctttggttaaatcaaactgtttactgacaccattgatattcatattttctcctcttccctcattcttttcttcatctctttgttattctaaaccttcgtgtgaactctaaggcaagagaaaaacgaaaagtttcccacaaatttgtaagaaactttttttcgaacacaatataagttttaattattcaggatcagttgcaaccaatccaccggccaaattatccatatttggtttatcagccgttacaatcaactgttcattaacaaaggcatttaatcctaagctactcatttctcggccatagccagaattttttacaccgccaaacggtaagtcgggtagagaagtcatgaagttattcacgaaaaccatccctgtttcaatccgactagctacttttgttccacgtttaggatcaccactgaaaacaatcccgcctaaacctaaatcggaatcattagctaaatcaattgcttcttgctcactattaactttataaacctgagctactggtccaaacatttcttcagaatatgccggattatcttttttaatgtcagttaaaatagtaggttggaaaaattgaccgggcaaatcaatttttttattaccatagtaaagcgttgccccggcttcaatagcctcatcaacttgactttgtaacttatcttttgcccgtttagaattcattggtgctaaagttgtttgactatccattggatctccaggtttcacattagcaaaattttccttcaactttgctaaaaattgatcatacaaattggccgccacgataaatcgttttgacgatgtacatacctgacctgcgttgtaaagacgagctcgccaagcaatatccgctacactatctatatcagcatcatctaataccacaaatgcatcagtaccgcccagttccatggtgtttttcttcaagttttcaccagctgctttggcaacgctacgaccaccacgttcagatcctgtcaaagcaacaccttggacccgcgaatccgcaatgatttcactaacttgatcataacttaaaaatagattttgcaggctagcatctggggctgatgactccttaattacatcttcaaacgcaaccgcagatcctggtgtgtttgacgcatgtttcaagatcatcggattaccaaccataaagtttggtgcaaacacccgcataatctgatacattggaaaattccaaggctccaccatcattaaaataccaagtgggtgcttttttatctgtgcatccccagtagcgacagtttcaatttttgttggtgctaataattgagccccatgatcagcaaaataatctgcaatcaatgcacaaagttcaacttctccttgggcctctcgatatagttttcccatatcagtcaccatagctttagctaactggtcactgtgcttgcgaaacaatttggcaatttcatgtaattgtcctgaccgattctcgggtttatctgcttcccactgtttgaataaccgatgtcccactgtcaacgccttttgaatgtcatcggtcgttgcatttgggtattctttcacaacctcatttgtatatgggttaattgttttatacgccataagtttcctccatctttcgatactttctattttttcctaaatcactattaattcctagtaacctgtttactcaactacaaatgtagcaccattttccttggccaacttttgaatcacatcaaccgtatctgctaaaggtgttgatgcactggttgaaaaagccacaacttctttacccgtaaaattaccctgttcaaataaactatgaataatcattggcggttgtgaccaccaagttggataacccacgtaaattttactatattgattaaaatctggtaaattaccacccaatttggggtgaatttgattatccttttccttttcaccagcagctactatcccattgtagtcggttggatacggcttttctggttgtagttgataaattgcagctccagtcttttttgcaatttttcagctgcagattttgtattacctgttaatgaaaaataaataattaatgagccttcatcagcaataatcgacacctccaatataaaaatctttatttttttgtattattgttttggctggtatgcactaaaacttaacctggtgaagtttctctgtcaccattcattttagatgttgtcataaatatcgttaaacctgcctttcatattcaacaaggtcatcataaaccttcgtgtgtactctaaggcaagaaaaagattcgtttttttgaaataagatttcttcagaacatgttatactaaaaaaatatgcaagaaaatatgagataaagaaggttttactttgaataaagaacgcttggcagcttttacagatgctgttctcgccattatcatgactattttagttttggaactggaaaagccaaaaactgttaatttagctggcctatgggcgttacgcgctaacttttttgcttacacactatcgtttttttggattggtttaatgtggaccacgcaccacaataattggcacaaagtaaagagtgtttctaacgcaaccgtttcttattccttagtcatgttatttttagcttcattctttccatataccacaagcttagtagcatccaattttaacaacgtcaccgcccaagcactttatggcgttatcgtattagctgtttcgtttagtaacatggccatttcttattctttaaaaaaagtaaatcctgctgctcattttggctggttgtatgccttacccaactcttcaattattttggacgttgcaattaaattagttgggctgataatcacattaacattttatgcaccggcaatgatttacgctattttcattgatatatttatcgtgggttatgcaactagacaatctagtaaaaatcagtttcacttaaataaaatttaatggtactaatgattgcaaaaagcgattagttttataaaaataataaaactaatcgctttttcactcatcatgttttgcattcatacaaatttaactatagttcaatctcactgaatcccgaaaaagcacaacttcaaggaaagtttaggcaagacatatttactatgttaaacccttcagactctggacaatcaattatgtatcctaaacgttcaattaaaaaattatgaaatatactcataatcaatatttattgaaagtaaagcttttgtttatcttttctccaaacacagtggtaaatttaaagtatcaagtcaaactcttatgaaaggcatttattttgaaacaagaatctttatttgcgtcagaaaacaatcaaaatagcccactagccaaccgcgtacggccacaaactcttgaagagtttacaggtcaaactcatttattaggcaaaggaaaagtattacgtgaaattattgctcaagatcaattaccttcaattattttttggggcccgcctggcgttggaaaaacaacattggcacaaattattgccaaccaaactaaatctcattttgttacttttagtgctgtcacaagtgggattaaagacattcgcaaaattatggaagaagccgaagaaaatcgggaactcggtgagaaaacaattgtttttgttgatgaaattcaccggttcaataaggcccaacaagacgcctttcttccatttgtggaacgaggaagtattactttaattggatccacaaccgaaaacccatcgtttgaaattaattccgctttattatcgcgttgtaaagttttcgtacttaaagaattgagtactgccgaaatcagcagtttacttcgcaaagctttaaataatgcgaatgcttttccaaacttaaaggtacaagttgacgagaatactttgactcttattgctcaatttgcaaacggtgatgcccgtattgctctcaatactttagaaatggcagttcttaacgccgatcatcagaataagttggtcataattactgaaaacaacttgaatcagtttattaacacaaaatcactgcgttatgacaagcatggtgaagagcattacaatattatctcagctcttcataaatcgatgcgaaacagtgatgtaaatgcagcaatttactggctatcacgcatgttagatggtggtgaagatccgctttacattgctcgacgcttagttcgatttgcgagtgaagatattggtgttgccgataccaaggcacttgaactgaccattaacgtttttcaagcctgtcaatttttaggaatgccagaatgtgatgttcatttaactgaagcagttgtttacctatcgttagctccgaaatccaatgccatttataaggctcgcttggcttctaaaaaagatgtcaaaaaaaccggcaatgagccagtccctcttcaaattagaaatgcacctaccaagttaatggacaaccttggatatggcaagggttaccagtatgcccattcagaaaaagacaaattgaccaatatgaagaccatgcccccggatctggaaggccatgaatactatttgccaactgaagaaggtaatgaaaaacgatttaaacagcgcttagaatatataaaaaattggcatgctactcatgacaattaattaaaaaaggatttgcaacatcgaaaaccaatgttgcagatcctttttcaaccgcttaatattgcataagtgaaagcatatcataatttttaattttatcacgcccatgtaaatctgttaattcgattatgaaagctgtccctacgacaattccaccgagtttttcaactagatcaatcgtcgctgaaattgttccacccgttgcaagcaaatcatccgtaactagaacccgttggcctggcttaacagcatctttatgaagataaagagatgaggtcccatactccaaagaataagttgccttaactgtttcgcgaggcaacttgcccttctttcgagctggtgcaaaaccaacgcctaattcgtatgcaaccggacaacccacgataaagcctcgggcttcaggacccacaatcatctcaacgcccttattacgagcataatcaacgatttgattggtcgcttgcttataagcttttccgtcacccattaaaggtgagatatcacggaaaacgacacccttttctggataatctggaatacttgctacataatcatgtaaatctattgccatttattcagcaactcctttgtttttatctgccaaacacgcttgcatccaagcagtcagagtagcagacttgctgtacaataatttttcttgtgtttcaatttgttgttttctcaattgataggtcggagccacactcaacttctgcggcttgggattcggaatagacgaaacacgaccgctttctattttaacaaatttcaactcaaaaaacacctgaattagaaaaactatcatgttttgatcaatatgcaagtgcttaactacatccggcaattgtttcttcaagtctatgtcttgatgattggcaaaaaacttgaacaccttagcactctgttctcgggttggcatcccatccaaataggcattattttgctgatagaaataaaccgtcaaggcatctggactttgttttgaaagccaatctgcaaactttgtgattgagtctgggcaatcaaccaatgtcaagttgcccttcaggcgcaagtcaaaattttcttgatcttctaaaactgctacttgaacttctggtttcaaataggtttgcactttttcataactttttttgtggaagaaaacataggtggtctgagttgcaaacatcttaacactcaaacgagttgttcgtttatcaacaatcggtacagcgttaatcaataaatcttttatcatgatttggggcttagtttgatttcgccaggtatttaactccaaagttcccacaactcgcacatcttcaggcagtgcctgtaaatatggcatgagcttaccttctttaaaatcaattgcgtctattttttgtttgacccctgctaattgaaatttcaaatgatcctgattagcaccaatttgctttacatcagtaaccttttcagaatcaatttcaaattctggaattggattatcggttccaaatggtcctaacttagccaaatctttaatcgctggaacagtgatttggtcaactttaaccacaccatcaatgggcaatggcgaaacctgatttttatctagatcggctactgttgctgcctcttctaaagtggtttgtagagccgccacattctctttagctatcgttaagccaactgccatatgatgaccaccaaaattaacatataactcacgatttgtattcaaagcctcaaacaagttcagagcttccacgctgcgaccggaaccctttaaatttgtgtcggtttcactgccacttaaaactaaagttggtttaccagtagcttctactaatcgactcgccacaattcctaaaactccctgatgccagccaattccggtaatcaccaaagtcttacgcgcaagattttctggagatttcgcttgcaaaatggcttcattgtacaccatatcaactaattgtttccgttgatcatttacagaatcaatgtgtttggcaatcaactccgccttttcgtcatcgaatgtcgtcagcaattcaactgcttctcctgcgttaccaattcgaccaaccgcatttaaacgcggagccagtgtgaagccaatatcttgttcattgatttgtcggttttctaacccactcaccttgagtaacgcactgagaccaacacgttgaccttcacttaaaacttttaaaccactagctactaagaaacggttttcatcagtaagtgataccagatccccaactgtcccaatggcaactaaatctagaaattcttctggcacctcatccaacaaagctgaggccaccttaaacgcaactccaactccagaaagatctgaaaatggatagtgtgcgccaggatggcgtggatgcacaatggcagttgcgttgggtaatttttcaggcaactcatgatggtcagtcaccacaacatccatcccgtgtgtcactgcgtattcaatcggttcgttccccgcaataccattatcgacagtcaccattaagttcacgccattttcaacaaattgttgatattcagccatgttgggaccgtagccatccttaaagcgatctggaacgaaataatcaacgtttgcacccaattcatttaacgtttcaaacataatcgtggtactggttaccccatcagcgtcataatcgccgtacaccacaattttttcattctttacaatggcagactgaatgcgatccacggctttttgcatgtcatgcaacaaaaatggatcatggatagcttccggatccagtgttaaaaactttgttgccttctcgggcgtatcatagccccgattaattaaaacctttgccgcaatttcacttaactggcaggcatccataatttctttaattttgtctgatgacacatcgcttttcggcaattgccatttgaactttgatttcagcacgattccacttcctaatcaataaaaacagagtggacgaaagttgatccctacagagatacttgctttcgcccaatttttagtattcaattctcacaatctcacagaaactaaagctcttcaagattatgatttttttgcccattttcgttactaacattgtttacacgtcgttttaatgattcattttcttcacggaggtcatcaatctttttggtagcaacatccatttccactcgttgttgttttttttgtgccatcactgtacccattgacactaaaaaagtgatcaatgctccggcaactaaggaaactaaaataaccaaaacaagtggccagtgcaccgtggtaaataataaactcaaaggaacttcattcacattgacgacagcgaaaagcgccaccaacaaaactaaaattaaaatgataataactcgccattgattcttcatatctatattccttactttcgattaaaaaaagaactacttgccaacaaatcaccaaagtttgggaaaagctcgtacccacgatgaataatttccatgtaggtcggtgcattgatttcacggcgtcgatagccaactgcctcaacaatttgatgagcaactttttctggcgacaaggcaagtaacttaacagcgtcaaaataatgaccacttggatccgcacgcttaaagaagtttgtatccattggtcctggattaacggttgtcacctgaacacctaatggccgtaattcaaggcgcaaagcatttgagaaaccaattactgcaaacttagtagcagaataagcagtcgattttggtgttgcaatctttcccgcaacggaagcaatgttaaagatttgtccccggcccattttaatcatttgttgcgcaattttttgagtcacatacattagccctaaaacattcactcgaaacattttctcaactggttgcatctcaatatctttgaaaggttcaaacaagccaaaacctgcgctattaatcaaaacatcaattgatccaatgtcttgcaaaacgtgctctagttggtgatcaatagcttcagaatctgaaacgtcaagcttgaccacaaacgcgtcagcttgcgaaatttccttacatctctcagccactttgcgaagttcttccacattacgtgcacacaaaacgacactagccccacgttctgccatttcataagcaactaatttacccaaaccacttgaagcaccggtaatcaaaaccaacttaccttcgagattacgcaactcttttaaccgcgctaacatatgatcactcctcaattatctaagtggaatattaataacatcaaaatcgtgaacaacttttgtcgctttaaacactgtttgagcttgcttttgcagttcattggccattttaccagtatatcgcgccgaaatatgtgtcaaaatgagccgatgaacattagcttgtttggcaattcctgccgcctgcacatttgttgaatgatagtaattacgcgccagtttgctctcatttttagcgaaggtactttcatgaactaatacgtcagcatcctttgcaaggaccaagctattcttggtttttcgagtatcacccaaaatggcaacgattcttccccgttgcggtttgccaagaaattctttgccatcaatctctcgaccatcttcaagtgtgactttttcgccacgctttagttgcccataaactggccctgatggtatgtgaagctgtttaagtttttcaacctgcaattgtcctggatgtgatttttcaacaattcgataaccgacactttcaatacggtggtccaaccgcaaaaaagaaactttaaatttattatcttcaaaaatcacgccctcgtctcctagctcaacaaagcgaattggataggagagatgtgaatctgaaatgcgcattgccgtttgaacgaactgacgaatgcctttgggtccgtaaataattaattctgattcgccgccttgaaaagaacgactacttaacaatcctggtaggccaaataaatggtcgccatgtaaatgcgtaatgaaaattttgtcaatttttcgaggtttaatattggtgcgcaaaatttgttgttgcgtgccctcacccacgtcaaaaagccagatcgaattacgctcatctaaaagcttcaaagccacacttgtcacatttctaaatttaccgggaacacctgctccggttcctaaaaattctaattccataacacgtcgttccccatttactcttgtttataaatcctacctaaataccataccacaaaactgccctgatttgctatggcaaccctcttagtttacacttcatatggtatctgtaatcaattataattaattttgtaacaaataaaccaaattcaaacgatataatggagaatacaaatgcgattagtcgattttaatttatcagtggccgaacttgatccacatttacaagtgtattttgttcaggataaacgtaattttccggtcgaatctttaagaattgaagacaactggttaattatggtcgccggtaaaaaagccttaacgttggatcaatttaaggctagagctcaaacaattagtggtgctgcccaacttgcgttttcaaaaaatggcccccataagttatttggctatcatttacgtagtggtaagttaattttaggataaaggatgaaaccaacatgaaaaaaattgtcatatttttactactcagcacaacatttttaaccgggtgtggaaattcaactcacgaaacacgctatcaggacaaaggaaaagttactttcaaaaatcaaaataaaaatgtccataaaaacagcggttcaattagtaaagaaagtagtgcctccgcttccagtgcatctgcttcttcgacaaacaattccacaaataccaaagaatcatcaagttacacagttccaaaaaacattaaaaaaagcgccagatatgttgcccatggtgatttaaacttgcctaagcagttttcttatgattcttttgggacaaagttaacccttgataagatcaaaaaagttgatcaaaccatcatcaaccggccgctccaatttcaaatcaaacaggttcgtttgattaaaaacgaagccaaaacggcaaaggctaaaaaaatggtttccacggcgtttagcaatacaggtattggttctacctattacactttacaaattaaatacacgatcaaaaacgaaagtaactctacaataattgttggcggtcttaattatgtcaagctttctgctaattatgctggtacaccgattagcaatatggttgatagttctgctggcaaacaaattagggcaggaaaaacaattaacacgacggtagttactttggttccaaataatctcgcaaacagactacacagttgttccattcaattttcaagcacctatagtatcagtggcaaatccctttctaaagattcactggttacaaaaattccattttaaataaaaaagttgcagaatctctacaactttttttgtgtatacgtattaatttttgaaacatgttcaagcatgatagtaattaagcctggagtttagcgaagcccaaaaaactcaatattttacttttccaaactctcgaatttagtcttcactaccgtacttaacaattgcttttgtcacaagcgttgtatattctttgctaccttcaatattaggatggacatgatctccataaaaccatccggtttgtttcaggcttgcatcataccaatcaatcacatgaatatttttgtaacgctttgcggaattggcaatcgtcttattaaccgtcgattcccaattctgagtaggaacatgcacatttacccagaatatttcccgtttactgccaaccacggacacaattgtctttaactgctgagttgtaaaggcaccattagtgcccaaatttattagaacattactactcaagttaccttgggcggccaactgttttaataaacttgttgcttgccaaacttgtctaccaacctttgccgaaatataggcattaggaaatacctcctgcaaatcatcagaagtatcagccatgatggaatcaccgaccccggtcactgacattttttgagccaattttacttcagaaggctccaacttgtactttgttttgatttttctttccgcatcggttagcttgatggctttttcttttttaatactggccaactgtgcctctcgctgctttttctttaatttagctagtttttgtgcttctaaagcttttgcattttgttttgatgactttttcttattttttgtaatattcaattgtaaggcactgtggtgattgccatttttgccagaaccactaacaactccaacactagcaactatcaaaatcagaatcacaggaattgcaatgtaccgtttgttgccaaattttgagtcccgtctaaccaaatttctcaagaaaataaaaggattcccgaaattgaaatgagctaatggcacttcaacaaagcgataggaaaagtcacttatgatcacaatgatcacggcttccatcaacgcattcatcaacggatgaacagcaatatttactactgctttttcataaaaaatcatgacaggaaactgatataaatagattccgtaacttcgtttaccaatccaagcaaacaatggattactaaaccaattaccaaatttggttcccggatgtgcaattacagcaattaaaatcacagagaatatcgaaaataacaacatcccaccatgataggcaaaatttccggttccacttaatgtcaaacccatccaaatgattactgctagtgacccaagtcctaaaacattgagtacccagcgaccatttttattaagctttggattcaaatgagtcgatggccagagaaaagccaatgcagctcccaataaatagggagtcatccgtgtgtccgatccgtaataaacgcgattagtattggacggatcatagagaataaacatcagaatcgctgaaacaattgccaaaccgtttaaaatacccaaaatatggccccgatttttaaaggtaattaacaaaccgataagcacaatgggccaaataaaataatactggccaattactgatagataccaaagatgggtaaatggtgattcaccgttatatctatcaaagtaggattgaccattaccaatttgccaccaattataaacgaaaagtaaattagtccacacaatactacgaatattttccagtaggttgcgagcaaacaaagtcatataagctgtagttgcgattaaaacaaccaccaaagttgggtaaagccgtttaacccgtcgtttataaaatgatagtaccttaattgaaccattttgatcccactcttgtacaaacaaatcagtaattaaataaccagatatggcaaaaaagatggatacacctaaatacccacccttaacgtcatacggtaaaagatggtaaagaataacacccaataatgctaaggttctaagcccatcaaaaccactaatataacgactattcttcagtcttttcccctgttctttttttactgattgattattttcatgggttgaaccactgcttctcccgtttttgccaagagaattttgtttttcataatccatacacaattcctctataaataagttaacctactcaacaaattcaaacgtaaaatcaagaattcggacagtatccccattcttaataccggccttgcgaagagcatcgtcaactcccataccacgcatttgacgcgcaaaacgaattaaactgtcatcatgttcggtattcgtcatcttgaataaccgctcaagcttttcaccagataatacccaagtgccatcctcatcttgttcaattttaaatgcctttttaggtgtataagcatacgtgacgtcatcgtctgaaacaactggcgtttcaattggatctggtgttgtttcaagaacatcagctgtatgttgcattaatggctgaagacctttatgtgtgacagatgaaatcggaaaaatatctggaacttcatttggaccaacagatttttgtaatttttcacggaacttctttaaattttcttctgcatctggcatgtccattttagtaggcacaataatttgccgacgcttgattaaatcgggatcatatttgcttaattcttgattaatcttttcataactttcaaacggattttcttcctctacgccactcatatcaaccaaatgtagtaaaacttttgttcgctctacatgacgaagaaattcaaagcctaggccaactccttgtgaagcaccttcgattaatcccgggatatcagcaatgacaaagtcgcgtccgtcatcaagttgaaccatccctaaatttggaaccaacgttgtaaagtggtattcagcaatctttggtttggcacttgtaacaactgaaagtaacgttgatttccctactgaaggaaatcctaacaagccaacatcagctaacaaacgtaattcaagttgcacactgatttcttgaccaggttccccattttcagcaatttcaggtgcgggatttttgggacttgcaaaatgcatatttccgcgaccgccgcgaccacctttggcaataaccaaagtatcatcgttatccactaaatcaccaatcacggcgccagtttctgtatttttaacaatggttccccctggaacacgaatgaccaaattttctgcactccggccagtcatttgtttattcataccattactaccagatgcagctttgaatttacgctgataacgaaaatccatcaaagttcttaatccggaatccactttaaaaactacgtcgccaccgcggccaccatcgccaccagcaggcccgccgttgggaacaaatttttcgcgacgaaaagcaactactccattaccaccgttgccggctttgatattaattttaacttgatcaacaaacatatttttctccaatactgtttagcgtgactttttctaatctaatagtcctattttagcagatatcagtcttattttataatgattctgaattctttttgtttcagattaatctatgcggctatttccatctatactttgcttttaatggatccacttagggaaattttaatcgtttttgccacattctccggaatgcccaactcacgcatgtcatccacacttgcttctgcaattcgtcgcatcgatccaaatttccgtaaaagtttatttcgcgtttttggtccgaccccagcaatatcatctagccgtgaactcaaggagtgcttcgtgtgcacctgtcgatgaaaagtaatagcaaaccggtgcacttcatcttgaatgcgttgaaccaaatagaagccttggctctttggatctaacaatacatgcttgtcttgtggaccaaaaagcaaatcagccgttttatgtttatcatttttaaccattccagcaactggaatctgaagatttaattcatttaccagcacatctttgactgcatttaactggatatccccaccatccattaatatcaagtcaggcatgctctgatgttcctttaaaagccttgtgtagcgtcttcgtatcacttcacgggtactttctgcttcatccgcatgatccaccgtggtgagcttgtacttacgatacatcttcttatccggttgaccgtctgtaaaaacaaccattgctgaaacaagatctgctccttgaatatgagaatgatcaaaagcttcaattcgatgtccagtcggaattccaagagcatccgtaatttctttcattgcccccactgtcttagaatcatcaagttcaagcaaccgaaacttctcttccaaagtgattttggcattttcctgagccaaattcattaaatcacgtttttggcctctctgaggtgtgcgaacaggaatcttcaagatatcactgataacctggttttcaataccagctggcacaagaacttcgtttggaagcaaattattcttttgattataaaattgcagaataaaggtggtcaattcctcggttgccgtactaacaactggaaaaagtcgtttttcacgcttcattaaacgtgcttgtcgaataaaaaacacctgaattgagagccatcccttatccatgtaaaagttgaaaagatctcttggtgtatgatcattggaaatgattttttgcttttcaaccgttacttcaatatagtgaatctgatcacgaatatcagccgcccgttcaaactccaaattttgagaagcctcatccatttgagtaacgagatgctttttcacagtcttcacatttccattcaaaaacgatttaatgcgggtaatttgttttgcatattcttcttgcggaactgttttaaaacaagcacccaaacactgccccatatgataatacaaacatggtcggtgctgaaatcctgtacaccggcgtaaaggatacactttttgcaaaaagtgtaatgtttcttctgccgcataaacattaggatacgggccaaaataataagcgccgtctttttttacatccccagaaatcaacatctgtgggtctctttcattggtaatcttaatgtacggataacctgttccccgttttagcttgatattaaagtacggttgatattttttaattaacgtaatctctagtaagaaagcttccttatcactagatgtgacaatatagtcgaaatcggcgatctcagaaactaaacgggccgtttttccgtcatgagagcttttaaaatatgaacggacacgattttttaaattttttgcttttcctacgtaaataatctggctattaatatttttcatttgataacaaccaggtaaatctggtagcaaagctaacttatgctcaatgtgctctgatgccatccgatttcacctcctaatgtaaagaacttgtaatattataacgcctttcatggcttagggcaacaataaagccaaacgtacattcgcttgtaaaaaaacaaaaacataccataagattttactcttatcgtatgctttaaaccgacaattttattgaaccaatacctttgacaaaaaatcttgagcacgttcactttttggatgatcaaaaaattcttcaggggttcccttttcttgaatgtacccaccgtccataaaccaaatctgatcggctactgaccgtgcaaaccccatttcatgggtaacaacaaccatcgtcataccagctttagccagctcttgcataaccttcaaaacatcaccaaccatttctggatctaaagcagatgtcggttcgtcgaacaacattacttcaggttccattgcaagtgctcgggcgattgcaacccgttgctgctgaccacctgataagctacttggataaacagcgcccttatcagacaaacctacttgagccagtaatttctcggctgtttttgtggcatcttcatctgataaattcttaaccttcataggagccaacttaatattgtcaattactgtcatattagggaagagattgaaactttgaaaaaccatccccattttttcacggagttcatctagttgcttttctttaagattagtaagatccgtgccttcaaatagcacatgaccatcacttggctgttctaataaagttaaacaacggagaaacgtacttttacctgctccagatggtccaatgacacaaataacttgccctttttcaacagtttcagaaatattttttaacacttcggtttcatgatattttttatttaatttttgaatgtctagaattttagttggcatgtttcattctcccttcaaaataacccaaaagtttcgaaagaccaaacgtaacaacaaagtataacagcattgccacaacaataggcgcaactccacgataagtgtcagactgaacgatcttcaattgataaatcaaatcggtaacaccaataattgaaacaattgagctttccttgattaatgaaatgaattcatttccaagtgctggccaaatattttttatggcctgtggtaaaacaacataacgcatcgtaccttgtttggaaagccctaggctcctagccgcttccgtttgccctttatcaacggaattaattcctccacgaataacttcggcaacgtacgcaccactattaagagatacggcaataatccctgaagttaaagctggcaaattaacgattaatccaattccaaaataaacaaacataatttgaaccatcaaaggtgtgcctcgcacaaattcaatgtatgctgttgacactagttttaataatttgtttctgcttaaacgcataaatgctaagatagttcctaagataaaaccaaagaacacagaaaacgcggaaataagtaaggtataaccaatccctttagcaaagtatttccaatagtgagtcattgatgtatcgactgtattggtcttcatatgggttccggcttcttttaagtaaactttgttgattaaatctttcttattaatcttggccaagcttttatttacggctgcagcaagggtaaatgaacccttttggaaggccactgctgaactactttcgttagagctcaaattaaaattaccattaatcaaactgagttgtggattgtttttgacgtatgcttcagcacttggtttttccatcacaattccgtcaattttattggtttgcagggctaaaattaaatcagcacctttatcgaatccttttacagtcacattagaaatttgtttttttgccatgttgtactgcatggttccggtttgtgcgccgacggttttaccaacaaatgactttttgctcttgtagataccggcatcctttttattaataacgatatcttgaccacccttataataaatatgcgagaaggtcacgttctttcgacgagcagcggttggattcatcccagccataaccatatcaaccttacccgtttggagggcaacaagtaaggaatcgaaatccatgtttttgatcttaagttttacgccgagatcttttgccacctgcttggcaatgctgatatccattcccacatcaatactcttgccatttttagtggcttgaaattcataaggagcataatcaggactggttcctaaaaccaaaacgcctttcttctgaatctttgccaatgattgatcgtttgaactcgtctcagagctagcagcgttgatacttccaaatggcaatagggtaaacaacaatccaacaattgtaataatttctaaaaacttttttttcataatcgcaactccctgcatcaaatagaatatatgaagtatagcttcttttgattatttatgcaagctttattagaaataaatttgttttatgcacgttttgaacgctatattcgcttttaaatgtatatttcttaatttgctgacagatgatataaaatctgttatgataggcgcaaggagtgatgagaatgggtttgaaaattaaacaagagattaaccttgaaaagatgttagataaatttgttgcacctgtagaagacaaaactacagcagacaagaagaataagtttctgaaacgcaacaccgaaacaaagaaacctaaaaagcaaaaaaaatgagcgaattttcgacaacttgccgaaattcactcattttttgtttactcatctaaaggtcgaaagtatcaaaattattatatcagtgtgttgatcgcaaaaattagacttagtctggaagcaaatgggctcagtagtgttttattatttttaatggagagttgtccgagctggccgaaggagcatcattggaaatgatgtaaacgggtaaaagcctgtttcaagggttcgaatcccttactctccgtaaccgaataataagtttatgacccgttggtcaagtggttaagacaccgccctttcacggcggtaacatgggttcaaatcccgtacgggtcattatggaggattagctcagctgggagagcatctgccttacaagcaggaggtcacaggttcgatccctgtatcctccatttccatagcaacattggttcgttggtctagctggttaggacgcctgcctgtcacgcaggagatcacgagttcgagtctcgtacgaaccgttgttatgtatttgaaaattgaatgcacaacataggtattattatactcaagatggttaatggctcggtagctcagtcggtagagcaatgcattgaagctgcatgtgtcggcagttcgattctgtcccgcgccattcatggaggggtagcgaagtctggctaaacgcggcggactgtaaatccgctccttcgggttcggtggttcgaatccactcccctccatcttatagggatatagtttaatggtagaactacggtctccaaaaccgtcggtgtgggttcaactcctactatccctgttaataatactatggcggtattggtgaagtggttaacacatcggtttgtggatccgacacgcgtgggttcgattcccacataccgccttttgattgggttatagccaagtggtaaggcaacagactttgactctgtcatgcgctggttcgaatccagctaacccagttgggttagccaaagttatggcggtatagccaagtggtaaggcagaggtctgcaaaaccttcatcgtcggttcgaatccgattaccgcctttttccatgtattggccaatcaaatattattttgccggagtggcggaattggcagacgcgctggactcaaaatccagtgatcgttgagatcgtgtgggttcgaaccccacctccggtatcactaacaaatattaataaaaaaggaatcattgaatatcaatcaatgattccttttttattgacttgaaattgaatcaagaacaaaaccacaattaccgatacataccacaaccacgctcaacacgaggctgtgattgatgcggcgttgtacaataatgagtgacaccaacggcacccgtacacagcgttaaggcggatgcacatacaattaaaaatttcacggacgttcaccaaccttcataagttaatttaggatagcattctacgtgatcattttaacatagagatcaatgcgagtcattaccaatcaataccggaccgattaacgatagtaggatgtattgggtgagggagggtaagaaaattagtgagcctccattaccattgcctcactaccgtttttttgtttaaataggtcatctataaataatcggcgacaatttttaaaagaaaaagattgaagattatcgtcttcaatccaaagttatcttgattcagctagggtctagcatattgattaccacgcgatgcttgggttgcaccactggcatttgcttgagaaacactctcgtaatggtaattattgggattcttgacctcagaataatacttgtcactatcagaaacaaataccattccggatctagcaattgtccaaccgccatttgtagttgtggctgtagcactctgatgtgaattggaactcccagtcgaagtagttgaacgatgatgtgtataagccatcgtcgagctgcgtcggtgatattgtttggcgttgttgctgccatcttggtaattaattcggataccttcagcgtcattgataaccacaacttccgtgttcaaggatttatctgatgatcggacatcgacaattgatccacggggcatcgtttcgcttcccttgtacaggggagttgtttggtaataaataacgtggtgagtattggggttgtcttcccagtaattttccgccgcttcctctgtggcccgcattccaccattttgatcggcgcccacattttgcggtcgggtaccagttgtgaaattgtagtttgatgtatatgatttggcccccagcaaactgtcaccaatcgagtggctccgattataaaggtagccatgataggtccgccccgtcagtccataggtaattgataccattttgttttccggccaggcaggaggttccagtggatctccttgacggccgccctgggacagatgatattcagaataagtcagcactgctcgggcagtcgcagatctgccttgggcatcagctgagaaatgatagtcaccagctgccagcccggcaaaatggctaaaatgagcttttccagttgtccaataataatcaccagtcggcccggcggattccttgttggtataactcaccagcttgttcaaaatggcttggtgctgttggcttgccgacgcagttgaactgtggtgtgaatgagtatgaactttttttgctgattgggtggcatgagaactactggttgtagccacctgcgatgcgtgatgatcggcggcctgatgactgccactgccatcgctgcaacccgccaagccgccagttatggcaatcaatatgacggctgttagcaggatatgttgatgtgatttcacgttgtgatccccctcaaaaaatgtttcgttgaccaaatcaatcggccacataagtcgtaatacgataaaatgcgaacaactattcatttttattatacagttgaatctcatctgttaacagacgaactggaagatcgatttggttaaagctagaataaggatcaagaaacttgagcactgatgggggacttgcttctagagacccccatatgaggatccgaaaatgtctgacgatcctttcgtagtgtatgccattgaacgacacactaaaatgtcaactgacgataaaaaagcccgtcacgaaatatttcgtaacgggctgatcaatttaatcatctaatctattagacgttcaaaattttattcaagaaatcctgtaatcgttcattctgcgggtgttcaaaaatttgttctggggtaccttcttcaaggatttgaccgtcatctacaaacacgacccggtcggctacttccttggcaaatcccatttcgtgggtaaccacgaccattgtcattccttgcttggctaagtccttcataactgccagaacatcgccaaccatttcgggatccagtgctgaggttggttcatcaaacaacatgatgtctgggttcattgccaatgcccgcgcaatggcgactcgttgctgctgaccaccggacaatgattgaactgtcgcatcgaacttctcctgtaagccaacggtttccagtaactttttagcctgaactgctgcctggtccttggtttcctttttgagttcgacaggagccaacataatgttttcaccaacggataagtttttgaacaaattgaaatgctggaacaccataccaatattttcccgtaccgcgttaatatcaacatcatttctggcaatgtcgacattgtcaataacgatcgatccagaagttggttcctccaacttattcaggttgcggagaagggtactctttccagatcctgaagggccgatgataacgaccacttcatttttttgaaccgttagattgatgcccttgaggacttcattgtcaccaaaggttttgactaaatttgtgacttttactttttcgctcataccttagttctcctttgtacccaatttgataaccaagttaatacagtaataataatcagataaattgcggcaacgattgtccagactttgaatccttccaagtttctcgcaataataattttaccggtctgggtcaattcaagcaaaccaataattgataggattgacgtatccttcaaagtaataatgaattggttaataaacgacggcaccataattcgaatcccttgtggcaggataactttacgcatggcttttccaaacgggagccccaaacttctcgaggcttccatttgtccgggatcgacggcttgaatgccgcctttgacaaacgcggcgatatacgcaccttcgttaaaggtcagcgtcacgaccccggcgacaaaggcaggaattttttgccccgtcaaactcggaattccagtataaatgaacagtgccaaaaccagcaggggcattcccctaaacaggtaaatcaacgttgtcgaagttccctgactgaatttgttaggcaccacgcccatcaatccaaccaaaacaccgaagatggttgcaaagaagattgataccactgtcagccaaagggtttcttgcagccctgaccatagggcacctttattttgcttaattaagccgataaacgtccggtcttcggcgctgttgccagatgtcttggcagctgtcttaatctcatcagcacccaaatatttggccttaatgctatcatatgtgccgctggccttcagatctgccagtccttggttaaacgcctgcagaagtgcttggttatgaccttttttaaccgcaaagccatatggtgcatttaatgcgggcttggtgacaatcttcaacttggttccttgcttgattgcgtattgcataactggatgatcttcaaaacaggcaactgaattcccggttgagacatcttgatacatattgttggaatcatcgaatgtaaccactttaaagccgtatttctttttgatactattggcataatcggcacccgaggttccggttttaaccgcaacccgtttacctttcaactctgacaatttatgaatcttgctgttcttagcaacagccatgacaactccagaattgaagtacggtttggaaaagtcaaactgagctttccgttcgttggtgattgacattccggcaatcacaccatccgcttgaccagactcaacagcttggacggccgcgttgaatcccagggctttaattttgactttaaagccttgttcgttggcaatagctcgaattaaatccatgtcaattccgacgtatttgttattcttgttggcaaattcaaacgggggaaaggtaacatcagttccaataacgaaagttttgccttttactttggaattatttgcgtttcccagatacttaccgacaattttgtcgtaagtcccattcgcttgaatctttttcaggccggcattgaatttcttaattaatgccttgtgagtgccctttttaacaccaaacccataccaaccttggttagcaggcttgctggcaatttgaagctttaaaccgtgtttaatgccatactggagaacgggttggtcgtcgaaacaagcaaccgagttgccggtcgtgacgtcttgatacatattatccgaatcatcgaacgtcacggtcttaaacccatacttcttcttcaaactattggcataatccgcagcggccgttccggttttgagagctacttttttacccttaagttgtttgaaactggtgatgtcactgccttttttgacggccatgaccgcaccggtcttatagtagggtgttccgaaatcaaacttatcttttcgttccggggtgatcgtcatcccggcaataattccgtcaagctggccggattgaacggattgcaccgccgcgttaaatccaaccggcttaacattgactttaaagccttcctctttggcaattgacttgataatgtcaatatcgattccgacgtatttattttccttgttggcaaattcaaatgggggataagtaacatctgtcccgatttggtacgtcttagcttgtgcttcgctgcctggtagcgccagacagaacaagatcgtggcaaaagctgccagcaatccgaaagccgttaacactttgcgcttcatgaattattcctcctagacatatgtaataaaacataacatataataatgagaacataataccagaaatttgtgaatctgtatagcattaaccaatttgtgcaaacggtgccaagcttgttgtgacattgtaaaacactgagaattattaattttaaattagaaaatgtgttgacattgatttggcagtttatcataataatcattaaaattcatttagcatttttatgatcatttatacataccacattggaggaaatcagttgaaatttgaagaatcgaatgtattacagcagttgccgaaacaattttttgccggtctggtcaagaaggtcaatgctaaagtagccaccggtgcggatgtcatcaacgggggagggggaatccggatcagccgactcccgattttattgtcagatccatgcaggagcaaaccgccatacctgccaatcataaatattcgcaattcagaggtgacccggaactaaagcgggcagcggccaacttctatcaacgtgaatatggggtcactttagatcctgataaggaaatcgccattctcggcggttcaaaaattgggttggtggaactaccgtttgcactgctgaacccgggggacacaatgctgctgccagatcccggctatcccgattacctgtccggcgtttcactggcacaagtcaaactggagctggtgacgctgcgtgaacaagacgactttttgcctgattatcggaccattaaacccgaagtcgtggatgcggctaagctgatgtatctcaactatcctaacaatccatccggagctgtggccacgccggaattctatcagcagacggttaactttgctaagaccaaccatattggtgtggtgcaggattttgcttacggggcgattgggtttgacggccgaaaaccggtcagtttcttacaaactccaggtgccaaagaagtcggaattgaaatgaacactttctctaaatcctataatatggctggctggcggattgggtttgcggccgggaacgccgatatgattgaagccatcaatctgattcaagatcatttattcgtgagtgtcttcccagccatccagaaagctgccattacggctttgaatagcgatcagcagtccgttcatgagttggttgccctctatgaaaaacgccggaatcaatttttcaaggctgctcgggcaattggctgggaaccctatccatccggcggttcgttttatgcctggatgccggttcctgagggctataccagcgaatcattcgccgatctactgctggatcaagcagcggtggctgtcgcccctggtaatggttttggcaagggcggagaaggtttcgtccgggtgggcttattaattgacgagccgcgatttaccgaagcttgtcagcggattgccaagctgcatttatttgattagagtttactagcaacctcgttttgcgcctaaatgttatctagcagaactgtgcgccaataagcagcttccggccgtataaggggattacccaaacatccaagttctggatatttgggtaatccccttatactctggaagctaaccgcttatttgcccacgctcgttttcctaaatcgttaaaattagccgttcgcgcagctttattttagataatcgtggaactcaaagccaagcatctttggcctgcctccatagttaccagtaaccaagaagtttggtcaattttgcccgattcaaatcgcgattggtgatcgtggccatttcggtgccgtccaatccattgatggatttttcgaccggcttctgccatgcatatttggcaatcatattgccggcactggtcgctgcatacatcaagtctgcctgatagccggtgtggtcaagcccaagggtatggccaagttcatgtgccaggacaccatcccaatattgatcaatcgtaaatttggcagctagactgggtttgatataccccagcggatatttggcatcgtgatagtgggttttatcgataaaaatttgcctgccgtcgtaaagaccatcccagccttcttttgtcccgctgccaaatgaaatctttaaggtatagtggctttggcttcccatctgaaagacagtttcacccaaggcagtattccatttgttcatggcgttttgaacgtgctggttcaattccggattggccacgtaaatcaacgcgtgatgatccttgaacattgaggttggcgaaaaatgaaaaacgttatatgccaagtcaaaaacagcttcatgggtttcatagttcaccggcttcagacttaggatagtttcatccggattcatatctggggctgcattaatcaatttcatcagcgacttctgagacattgccacttgcgttttggttaaatagccgtgccaaatataccccgttattgttttgcttttattggcaacataatagtagactgccgttttaccattcggttttctgacggtcacccgtttagtagcgtagaagatcgtttccggataatttttagcgctgtgaagtttttgcgttagcgttttatccccataaataatccctttggctgctcgataggctgtgcttttctggggagtgacccggacaatttttgccgctgtggtttttgcatcagccgaggttgcggcaacatcaatcatcaatgctaacgaaagcagtccgactgccagcaacgttaatttttttacgacccgactcatttgaacgtgcctcctcaaagctgcaagtgtttccattaatataccatatccgattgataatttgctacttatggccttggcaggttctcagaagttgtgaccgtggattttatcagtggtaatctccggcattggttctaccagatgggtcgtatccctgtattcgatgcttagatgactcatgtttttaaggtcggagagaacctgctgatatttgtggggatcgtgaaccaacgctaataactcatgtgagcggaccaacttggtttttaatttccgactataaatgaagaagtaatagcggtcattaaaatggttgtcgacgatcaccaaccagtattggtagttgggaagtcgcttgaagtattggtggtacttgtcaattagttctcttgattctgccagcatggtgaagacctccttgagataaatcgttaagcttgatgaccgccaaccaaaccggcacggtcgattgcagtgccgcctttggttttggacgaagctctgattagtgctttgtaaccgtattttttgcggataatgtcgatggtttgctccaatttttccttatccaaggtagtgatgggatcctcaaacaggctgaagcgggtttcacgcttttttgaaagccgattgcaacgaaccccgacgttacgaactgcgctgccgtcccatttactttccaataaatagtggacggcattggcaatgcttttggttgagttggtgggttcaacgtgcatttgggctgagaagtgggttcgtccctgcttgtctgtggtggccatcccgatgaaaatactgacgacttcagcgacgacgttgttttttcgcaggcgggtcgcgacttgatcggcaatttcaccgaaaacagtttttagatcacccaattccgtgtagtcgcgcattaatacctgtgaattgccgtaacctttattgtctgaacggggaagataacgcttctcaaggttggagtagtcaatgccccacgcgtggtagtaaagctgttcacccatgacaccaaatttcttctttaacaggttaacgtcggcgtgggccagttctttaatggtataaatgcccaactgattgagtttgacggcggtgtggctgccaattccccacatatcggcaagatctggaatctgccaaatagtatcggggacgtcggcgtagtcccattcggcctgccaaggctcttttttcttggcggcgttatccagggccagtttggccagcaggggattttgtccgatgccaatcgtcgtgacaatgccggttgctttaaaaactttgtcttgaatcaatttggcaatttgggcattggaaccaaataatttgtggctgtggctgacatcgatgaagctctcatcaatagaataggggaaccagtgaatatcatcggtaaactgacggtagatgcggttgattcggtagttaagggcaacgtaatcggccatgtgcggttccaccatttcgatatccatctgatcattgacttcaaatcgtcgagtccccagtttgacaccaaagtttttcttggtgtagggactggcagctaaaatgagtccaccggaggattcttcgcggctcatgacggcaattttggtggaaaggggatgctccccgcgcttgatggcctcagtggaggcaaaaaaagacttgcagtcaatgcacataatgtcgtggctgggcaaaaggctgggattatcaagaggtgtttgcataaggatcacctgcgattggaaaagttttattgagtatctatataatacgaacatttgtttggtgtgtcaagaagaacagagcgcggaccaagccggttagcttctgagcatttatgtaatcacgagtgttgatgcgggttgggcatcaatactcgtgattggataaagcggaggaagctggcttggggagcgcattttgaaaacagagcgcgacgagacccgtttagggcccagaacataagtgaggaatgccaatgatgaacggtctgggttcatcgttggcattcctcacttatgtggccgggccctgggtcgtcggagcgcattttcaaggccgaagggagcagtaaatataataagcgcaacaaacctggtggaagctagcccaaaataacatgggaaaaggaagttgatttatgtataaggaaattgtatctgggtagaactaaccccaaaaagatcagtaactccacaaaaaagcgcccctcccaagttttccgccttgagaagagccgcttcaatttcatttttatcaattatcatcaatttcatcaatatttcaaaaataatcagacgctaatttgctgcttaaaaaatatctgagttaatcacctgcaactttcaagaacacagcgccaagccccttatcaaaggttgctttccagtcgccattgctgagtgattcaggtagtaggaaggtaccgcttgaaacacgttgaccagcttgtagcggcattccttgtgattcgagtttttcaaccagccagtgtaaggattttaacggattgcccaacacttctgatgaagcgccgtcctttagcttcttgccgtcatggaatagttcacatttaacgttggctagatcatcgacgttgtcaaataggagattggtatctttttcatcaccgtagacgacgtaaccaccaacagcagcatcggacatgaccatatatttggataggcttgggaaccagtcactgaagcgtgaatcaggtacttcgacagctggggcaaccttggtctttctcatgagatcttctaaagaatctttgctgctgagatcttctttagcagtaaagagcatttcaacttcagcaagtggttccatgagttcgccacggtgaagggtaactggggattgtaggaaatggctcttaacctgggcaccatatagtggtgagtcggagtcaaacatatcttgagtttgcttactggtaagcgatactttgtagccgccaacgtcttcctgcttgagttgggttagtcgtctttgaacccgataggctgacttttcatccttaacgacaccatcgtagtcggactcttttaatggcttgtgtgtctcgtaagcgttaaataatttgtttgctaattcattttccttagttgttaattccatcgttgcttgttcatccataagcgtttcctccataaattgtatttaatctgtggatcctcaactgtatgtacagtgaggaccactcagtgacgtgaaatatatgtgttgttatgtcaatggcactatgtcggttaaaattatgtgtttgcaaaatctgaatctgaccagggttttcattggagctgctaatcaccgattccataagtcctcaccaccttaaataattaattaaattcaaataaaaaggcgtcctccaactacccgaaaatggatagttaaaaggacgcctattgcgcggtaccaccttaatttgtagtgctattactagcattacctcacacgtacagctttcgcgatacgctgacacaataatgggtgcacccaatgcgatctactaaaactttgatcacatagctcggagatgataatcatctaaggacgtaaattgcttcgcaccaaccagcaactctcttattacgaacggaaaatgacgtttctcttcatcgctttttaatttgaatttaatgattgtcattaatttacaccctgttattttgattgtcaacagcaaatttgaaattaattattctttgttgggattttctcgaatcacgcgggcaggattgccggcaatgatgaggttatctccaaatgatttggtgacggttgaattagcgccaacgatgacattgttgccaagcgtaacgccggggagaatcaccgatccgccgccaacccaaacgtcattgcccaaagtcaccggtttgcccagacccacaaagttcgcccgttgtttgggatcaaggggatgataagcagcgtaaatttgcacgtgtggagccagcatgcagtgattaccaattgtcaccggtgcaatatccaagatgacgttatcgtagttacaaataaagttatcgccaacgtgaatattgtagccaaagtcacagcggaagttcggttgaacccaggggtcttttccgactgagccaaacagtttgcggaccagggcctctttttccgcaccggcagtgtcgtccagttcattcatcatcttacataagcggcgggctttagtttcgtcgttggttaattcgggatccatcaccaagtatggttcacccgctaaaaatttttccttttcagttgccatgtgattttccatcctttattgtaaattaatttatattatagcattatttgtaagtataaattgtctctaggcataatttattaggatgaattagaaattgccgagtgacttaatatcgggtatgataaatgcaattaataatagataaccaaactcacggaatttgaaaggatgcagacaatgaaagcagttattacagtgattggtcatgaccaaattggcattgtggcaaaagtttctcaacggttggcaactttgaaggttaacattaccgatatttcccaaacactgatgcatggtgattttaccatgatgctcatgggcgaatggaacgatgctgatgtgcagtttgaagttgtcaaacagggcttacaggatttggcaaatgagaccggcctatcgattaatattcagcgtcaagaattattcgacgcgattcaaaagctgtaggaggtcgccaaaatggaaaccaaacaaattttagagaccattctgatgatttctgaagaaaaacttgatattcgaaccatcacaatgggaatctcgctatttgactgtatcgatagcgatggtgttaaggcccggcaaaagatttatgataaattgacgaccagtgccaaagatttggtgaaggttgctgatcgaattgaatcagagtatggcattcccattgtgaataaacggatttctgtgaccccgatttcaatgattgctgctgcgtgtcacgatgataattatgtcgcctatgcgcagacaatggaaaaggcagcagaaaccctgggggttgatttgatcggtggcttctccgcgttggttcaaaaaggctaccaatcaggtgatcgaaaattgattgcttcgatgccggaagccttgagtgagacacaacgggtttgtggctcggttaatgttggttctacaagagccgggattaacatggatgccgtcaaacaaatgggccaagtggttaaagatttgtctgaaatcgatccggtcagctgtatgagtctggtggtctttgccaacgcggttgaagacaatccgttcatggccggcgcctttcatggcgttggtgaagctgataaagtcattaatgttgagattagtggtccgggcgtggttaaacgggcgcttgaacaggtcaagggggaatcaattgacacggtttccgaaacgatcaaaaaaacggccttcaaagtcacgcgaatgggccagtttgtcggtaatgtggctgctaaagcgctgaacgtgccgtttggaatcgttgatttgtcgctggcgccaacgccaagtcaaggggactcagtcgccgaaattcttgaagaaatcggtttggaaagtgtgggcgccccgggaacgaccgctgctttggcattgttgaatgatgcggtcaaaaagggtggcgtgatggcttgtgaacatgttggcgggctgtcaggtgcctttattcccgtgtcagaggacagtgggatgatcaaggcagttgagcacggtaatttgaatttggaaaaattggaggcaatgactgctgtttgttcagtgggattggacatggtggcagttccgggcgatacgccggctgaaacaatcagtgggatgatcgcagatgaagcagctatcggtgtgattaacaataagacaacggcggtgcgggtgatcccggcgaagggcaagcaagtcggagagcaaattgacttcggcgggatattcggctatgcgccggtaatgccggtaaacaccaatagcccagcgaaattcgttcaaaggggaggaagaatcccggcaccgattcattcgtttaaaaactaagagcgcgacgagacccggttgaccctggtatataagtgaaagacaacccctgatgaacggtctttgttcatcaggggctgtctttagcttatatgttaggggtcggggtcgtcggagcgtatctcaaaggttgaagggagctgtagatataatgagcgttacaaaccctgtaggctaaaggacaaaagacaacccctgatgaacgttttttgttcatcagggctgtctttgacttatatattaggggtcggggtcgtcggagcgtatctcaaaggccgaagggagcagtagataaaataagtgcatcaaaccttgtaacctacaaaacaaaatagaatcgaggagctcttgatgaacgtatttttttcatcgttgcctgcttctgcttgtacaatagggtcctgggtcgtcggagcgtatcgcagaggccgaagagagcagtaaataaaataagcaccacaaagcctggggactacaaatccttctccaccacaacacaaggcacgccgtcctcataaaacacatcggacgtgatctcataacccaggcgttgataaaatttgacggcgtccatttcactatgaatcagtgaatgagtgaaacccatttgtttggccttgtcttcaagggcactgacaacttttctgccatagccatgtcctcgcgcttcctttaaggttgcgactctgccgactttaagggtgtggtcattgtaagtttcaaaccgacaagtcgcgactggcactttgtcatcaaataagaccgcataaaccatgctgtcggaatctttgtcatcgaattcatctcgaaaggcgattccgcgctccaatacaaaaacggacattcgaatgtaagcagcagccccacgagctggtttggaactttccacgattaatttcataataggctcctcaaaatagacttcttgaactttaatattgagctggttatcatctgatttacgatacttctggaccggcaggccaatctttgccgacatcaacccaacggtcggcgtttgcatatttgctgagctcatcgacagacaatttgactgcgctgtgggtgtcacctgccgcagggtagatgaattcaaaccgctgaagggaaacgtccagatagactttaacgccttgattgagagcaaatgggcaaacacctcctggttgatggccaatatattcttcaacttgatctcttgggatcattctggcgcgcttgtgaaattcggccttgaactttttgttgtcgactttggcatcaccggccaacacaaccagcagtgggtgggaatcaatcaagaacgacattgttttggcaatatgttccggttcacaatttaacgcttcagcagcttccataaccgttgcgctggattcatccaagactttaatgcgatcggctaagccaacctcgttaaagtactgtttcactttttcaaacgacatacctatcactcccgactgataaagattaagactaatatacaggttcacggaagaatagtaaataagatcttgattattccagaatgaaaaaaatgaatgggcagttaaggatttgtctgggactgaaaagtggctccagttctgactggaatgggaattccaacagctacaaatggccttttcaagctgccaatcctgatcgggacttaattaattgtcagattaatggtaacatgaaaccctatgatccaaaattatgagagaaaactgaagatttgtttaagtattgatttggcgagagcttttgctagattgaagtgctaaaacttcgtaaaatatgcttagagacagataaagggggttggcattagtaatgtcacgtaaagagaagttcgctaaaaagcctaagaaaaaattatggacacgaatcctggtggggtttgtgttggttctttttggtggcttcgtgggctctcatttctattttcaaaatcatttcaagttcaccaaaattaacgacgttgatgtttccggtttgacggtcgctcaggcaaccaagaagttgaatacctcacatatcgatgaagacggcaattatttagtggttcgggattcaaaaatcaatgtgaattccaaggatgttaagaaattattcaaacaccgtagttcaatgagtgcgatgacttctgccaagctgagtgccaagtctgatgtaaccaacaagcaactcaactaccgcttgaagacgttactgccgaagtttgaaaaccgggttgatcaaatcaataccggtcgcaaacagaccatcgattcaaaagttattttgaagaatggcaaaattgttgttcaagctggccagcagggaagcactctggataaggccaagatggtcaaagactttaagaagcaggcaaaatcgagtttattgatttcggttaaaatgactaaagatgcgtacgtcaagccgaatagtactcaaattgccaaacagaagaaacagttagccaacatcttggacaacaccgtcacgttgaatacctacaataagacctataagtttgttgccaaacgctgggttgccaatggttacccaactgctaacgggacctataagtttgattcaaccaagattaagaattgggtggcaaaatttgccaataaagtcgatacccttggcaagtcggtttggattaccactcatcaaggcaagagggttcgtgttcatgctggtggaacctatggctggaaagttaatcaatcggctttaaccaagaatatcatgaagaatcttggccgatcacattccgtcacaatgaacttgaagcactatgcggtcggaaccggttatggtgttaaggggtctggtaagacctatgtcgccattgacctgcagcgccttcacgaatacgtttataaaaacggcaagctgatggctaatattccaatcatgtctggaacgttgaccggtggtaaccgaacccctcaaggcgccttttacattatgtacaagcagcgtcacgcaactttgagagggaggaacagtgatggttcaaagtatgcatcaccagtcagctactgggaaccattgaccaattcaggggttgggatgcacgattcaccatggcagcccgcctcggtctatggtaatccaagtgctcgtgcacaataccattctcatggctgtttgaataatccaccgtcgcgaatgggtgaggtgtggaagaacacgcacactttggaacccgtatttatttattactaagaagtcaaatgactgttgacagggaatcgcctgccaacagtcattttttgatttaatatatgttaaactgatgataaatagcaaaacggggtgaacaatcgtgcatttatataaacacgttgatattagcaataaccgcaatttggtttatggtctaaatgtggtcgccgttattgcctttttaggcttcctgtggctgtttggtcccattgtcggctcaatgactgtcaacttcactgaaagctacttcgtttggctgatcgtggcattattagtgattgtgacgatccacgaggttttgcacgggattctttataaagtgtttaagccaaatgggaaaattaaagttggtttcaaaagtggcatgttgtccgtttccagccccaagtccctctataccaagcagcaatttatttggattggggcgaccccatttatcgtcatttcactcgtcctgattgcgatatttcttttgggatggcttcctggcgaattattcttaccattggcagcccttcatggggcaggttgtgtcggtgacttttatcttttatggctggtgataagctcaccaaagcactattacattagcgatcaagaaaatggcatcgacatttattcccccaactgaattgttggatttcaacggtgtctcagatacaataaagggattgcaaccaaagtctgagctttggcggcaatccctttattggatggttaacgttaatcttggaccaaaattttaattcctaaatacagattataaatgaacatggccagatccaccaggataactaacgcgattagcgccaggaaaagaaatccagcaaaggcggccttttcggaaatcacaccactgataccgacaaccaggatggtcaggatggtcagcacaagggggattaaatgcaaaataagcgcgtgtctcgcagtgctgtgcatatctggattgttatcgctgacgatccaaacaatcagtggaaaaataaatggtgcgaaaacaattgaaagataggataaagcattaacaattcgatttgtcgacatgtgagtaactccttagtgattggaataggatttgtagaccggcgagcggaaaagatcgacgaatgcaccaccaccggaataatcccggagaacactgatcttttggccctcaacggttcggtgggtcttccgccagccacggtcactctgataggctttggtcgcataggcgttaaacgtgtaccggttcgtgccggagattttagcaaaagctaattttcgatagcccttccaagtggatttataaagggtgtgctgcttgccgttgtatttttgggtgactgagtacttgttaatctgggtcaaacagaacttcccgttgacgtatgaataccaattcccgcgccagctggtcggcgttgaactgtgaatggtgccaacatgataataagtgtcagcagcttgagcaggctcatgattgacgaaaacggtgaaaatgaaactggcagctgtgataacagcaaccttcaacaatttgttcatttaaattctcctaaaagtctccggatcaaaaacagaattattttgataaagttggctaattctttagattatactaaaaaatgatagcgtaccaagtgcggttttgtcaaataagcagaaaaaaggctcgctgactttggtcaacgagcctcaacaatgcaattattgtttatctttacttcttctgattggatgttctttttcttctttatcaacggacttttgatacattttatcgttgacgtacggataagtccacttaaccatcgctgacatgataattggcaaggtcaataccaaaatgatcaacccaacaatcacggtcatcgcaacttgaatcaaagtcaaaacgtttgacggaatcaacgcggcaaaagttccacccaagatgatggcagcggaaatgacgactgtcccaataatggttgccgaatttaaaattcgtcgacggacatccggaatggcgccggcatcaccacggtacctcatcatcaagaagatactgtaatcgactcctaatgccaccaacatgatgaaactaaagaacggtgtgttccaagtcagcatgttctggaacagcagatatcccgaaagccatttggtaatctgcagtgatcccatataggttacgattaaggtgccaataatggtaatggcttgaaccagtgagcgggtaaccaccatcagggctaaaccgattcccaccagcatgatgacaactgttcggaagaaatcgccattagcaatcttttgaaggtcagaagtttgagaactttgaccgccgatagcgaccttagcatttttcaaactggtgtccttcattttggcattcagatcgcgagtgattgtccgaatccggttagccgacttggtggtacttggatcggaattcaggaccacggtaatcttggtaatcttccggtcttttgacataaatgcgtcaagggaaggggtgaatgacgcactcttgatacttgcggcaggcatatagaaggtgttgcccaagtaagacttttgcatttccttcaagtatttgttaacagtggtggttccgcttgaaacttgatccaatcctgaattggcagaggtcaaaccagtttgtaattcctgcatctgactctggagctctttcattttcgaattcaatgtttgaacacccgaattaacttgagaactgccactagcgacactttgagccccggaaaccagtgatgaactgtttgaattcagtcgactagcgccacttgtaatctggttcaggccatttgagaacggagcaacttgtgaattcaagcggccaagaccggaagataactgtcttgatccggactgcaatgcggccatccgggcacgaagcgcctttagcttagcggtttggcttctcacttgagaaattcccgtgttcaatcgttgactgccagctgacaatcggccgacaccggattgaagactggaggtgcctgagctgagttgttgcgaaccgctggccaagttgctgacaccggcagtgtatgaggtgacgccttggctcagttgttgggcaccggcctctagtttgctggcaccatcagctaatttctcaacttgggcgatgctttcagaagtgtttgagttggctaatttttcgttggcactctttaaacctttttgaactttcttgatgccttgattggcttggcttaagccattagtaagactttccagctgacttcttagatacagtgaattgatttttgttccacctggacgggtaactgaggcaacactcttgaccccggcttcagaattcaggtagctggttaattggtcgatttcagctaaatgttgttgggtatccagtggtttcttgttttgaatatagacggtcgtcgggccggacatcccagcagggtagtgatcccgaatgatgttataaccggcttttgactgaaccgagttgggcaattcatcggcactgttaaaattgagtttctgactgccaacgaacaacagtggcaaagcagcaatgattaaaatcccaaccataatgaaactgtgtgagagggtgaactttgagaggaaattccacaggaaacttcggtcatgggcagccaggttcttgcttggccaaaagagtcgttctcccaaggtagacatgaagaacatattcagagtcaacagaaccattaatagaatggcaactccgacagcgaccgcaacgcctgaacggtagaaagagaacttggccaatgctaaggccgcaaaaccaattaagaccgatgaaccactatacagaatggttcgtccggcatgccgccgcgcacttcttgcggcgtcggttgcgccttgacccttacggatttcctctttaaagcggtcatacaataaaatgttgtaatcagtcccaattccaaacagaactaccaccagaaagacttgggtaaagttggagattgggaaatcccatcgttgtgccaaattcatgaccacgtccaatgacagcaggtaggagacaccgactgtcagtaatgaaatgacaggaattaagaaggaacgaaagacgatgatcagcactatgaagatgaagattgccgcaatgatttcggtcttttgaagtccctgctcagtaaccgttgaaaaatcttcatttaagacgtcactaccggttacgtacgttctcattcccggcgttttaatcttatccaagattttatcagtctggccacgaaccttgtcttttttcggcacggtgatcatgaccatctgggtggtactgtcttttgactgcagctgctgtttggcagcttggttgtcacttggggctgtgaccgagataatgtgcaggtccgggtcgttcttgacggcgttggtggcgtcttgaatctgtaaggtctgctcatcactcaacttgccgtgcttgttattgaaaacggcgatgagggttctggcatttttgccgccctcatattttttctcaatcttattggcaacttcactctgcaccgaagcagggagctgaacagtccctttgtcatggaccagctgggaaatatttggcaacgtaaaaattgcgaccaaaattaggccaatccacacaatcagtgataacagatgcttctctttgaatttctgcattaaaattcttcctctcattccctagtgataaaattattctcttgttcaaatttagacacttgtataagcaatattaaaatgataaactcggcgtgaatctgacgcaagggacattttgctgcgttagtttaaatttagacaaaattcgataaatgcaaacagaggctggctcatgaaatatgacttaacaaagaaaccaacgcgtggtgcgcaacgaaccttggaatcattttcgacgacgatgatcgcgcttctctccaaagagccgttcgaaaaaattagtgtcaacgagatttgtgcggttagtaattttccccgggcgactttttataactactttgacgataaattcgacttggcagcgtattgctggtatgtaattgcccaagaaattgaagtggatcaggcgaccgaattgaaagctgatcgaacattgatcacgtattttgatcgactttacgacgtgttcaaaaataaccagacgttactcgataacgtgcttcagtacaatgatttttccggacagctggttaacagttttattaattactttaaaaataagctgcaggaaatcctcaccaaatcaattgattattccaaggcgggcctaccggttgaattgatcgtcgatcattgcagtcagacggttgtactggttttaaaatggatctttttaaagcatcatgattccgacaaacagcaggctcatgaatatttggagaagttgttgaatattgaacattttatctgaattgacacatcaagtgaatcattcaatgactatatagtaccatgaacgaccttttcgtgaattgaattttcatgaaaatattgagcgaagcaacttctattatagcaaaagtggccttcatttgtgcgttaagttgagatgtgttagcatgctatttaagtgttcccaaagaatgcttaaatcagttcaatgatgaggaagtgacagaatggtcttaacttcagatgaagcagctgcaactaagcaggaactccaaggcaacttcgagttgtcagggatcactttgcaaatggcagccgttgatttgaaaagcacgcctgaacatattcaggacgttttaaacttgaaaaattgccaaaaagaagaaccttggattctgcgtaattacctaattaagctcattttgcttcaggaaaaagaaccctattcattctccaaattaataggggatcccaaacgttatcagtttttgaacagtcgcctgattgatcgtggcgaattggcctaaggttttaataaagtgaatgattgtgtcaaatgaaaacaatccaaaattagatccagttaaaactgcttgaatttcagttttaactggatcttttatattactccgaggatgaatgttgggacgtcggctaattattgctatatattgcttaaatggctagaatcaaaaccgctcgcactcgcctgaatcccaccgttgtttagcttaaatgtgtgaaagaggacagcaactaaattttaagcctctccagccaaaaacctaactcggtttccttgtgtctcactgttatttggatgaaatgtgtgcaagaggacagtaattgaaatttaagcgccgccacccgaaaacctgactcggtttccgaccagcggcgcttaaatttcaattactaaacgtcctctttcacactctcatcttgaagtggtcacatcactttgcttaacccagccattgacttgaggatgggcagcgtctgttacatagtagtaagtggcattgccatcgcgattattttgcttggtgccgaccttggtcacggtcagtggatccttgtaaaagtctgccgttgcgctgagattgcgccccactttatattgggtatagtcaggggcaacgtaggttaacgtggaagcttttggtgtcgtaaagtacattgtggtgttggcaaaataagttggcaccgttgattcctggaaggtcgtcgttgcctttaagccaccggaaacatcactgggattgattgtcggatcggttgttccggcaaatatccagccccgataggttttatcgaaggaaacaactttcaggtaccagtcgccatttgaggtctgagctgcccgataacctctgaagtaggtttgcccggcatcggcagttgtgccaagggtctttaaaacggctgccttggtgacaacttttgcactcttatagaccggcacttttgaatagagtggtgctgttccggttgtcaggtaattacgggaattgccatccgccacgagcgcctggttgctggttacagtcgtcgttgatttggcctcagtgttggttggcgttagggtaaatgcgccgatggcaagtgtcaggccaagtcccaatatgagtttgctggtgattgttttcaaattaatccctccaagcacaatctttattcaaaaagtatacacccatttgaaaatgaatcatacaatcgaagtcaattaaattaaaaaatgattagtttattttcgaatgacagttgataaaaatacatagttacctgatatacatcaccaactccattcattgaacagtttactgattagaatatttttaattttaagtatattttcgaggccattcgttgtatcctagttgtaaatattatttacaatagtggatattcatacaaggagtgacgacatgaaaaaacacgaggggttattttcgcaagttcgctggttgttcattgtgatcgcatttgtcggaatggtgatcggcctgaatacacaattggtgcatgcaaaggccagttcgctggaaacggatttccaacgagcggctgccaagtaccaggtgccggtagatctgcttaaagcggtggcttataatgaaagtgcgtttgatagccacaatggtaagcccagtgtggccggcggctatggtgtgatgcatttgactgataccactggcttaacgccaagcggctcagattccaaagcggttaaagtgccaaataccgcttctctgcatacgctgcaaaaagctgccaaattgaccggtcacagtgttggtcaactgaagaccaattcagctgccaatattgatggtggggcggctttattagcagcctatcagaaatccttgggcaaagggctaacgtcaaatattggtagttggtctgcagccgttaagaaatacagccagtcggattctcaggcagctgctgatttcttcgccgccaacgtttataaaattttggcaaaaggcgtcaatcataacggcgtcaaaatctcaccccagaaggtgaatgcattgaaagatgaagcaatcgataccaccggtgaatcgggccaaaccgatgggcctgccggcctgccaattgaatggattcccgcattatacaaaacctttgatgatcaaggcgactacggaaactatgatctggctgaccggccaaacgacgaaaagattaattatatcgtgattcacaacaccgaaactagttttcaagaagcactgacactcttctcgacaccgacgtataccacggcgaactacgttgtcagttcggtcgaagggacagtcgctgaaatggttcgaccgcaaaatgttgcttggcacgccggcaactggtacattaattctcattcaattggcattgagcacgagggttatgcggcagttggcggctactggtacaccgaaaacatgtacaagtcctcagcagccttggttaaatatctggctgataagtaccagattccgctggatcgtcagcacattatcggccatgacaacgtgcccggtttaacacctgcagctcaaaaagggatgcactgggatcctggaacttattggaactggaatcactactttgaattaatgggcgttgatttatcaaaaagtgacggcagcacggatagtcacattatcaccattacccctaatgacaagacgaatttgacggccgattcgggacaaaaagtgactgatgacggggtcaaccttccgctagccggatcaaattttgtctacctctacgagcaacctagcttcagtgctgatttgatcgccgacaaagacttttcttccggtcaatccggcaccactgaaaaggatgactggggcgataaagccgtttacggccaacaatttagtaagatcgatcagcagggggattggacagaaattgattatggcggtcaaggtgcttggttctacaatccgggcggtgctaattcaactgatgccactgggaagctcgtaacggctaaaggatcaaaagccgtgccggtgtatggcagtgcctatccaagcgacagtattttgaagaagaataaagttaccggcattaagccaacaccaatttatcaactgcagccaggtcaaaaatacgtttatggcggcacagtcacctctgattacttcaattcacacttcaattcaaactcaccgaagaacgtcattcatggcaccgatgattattatcagattcaatttaatcaccgaattgcattcgtgaaggcgtcagataccactctttcagacgattgacagattaatcgatagcaagtgaataacttggaaaggccgaaacagcaaccaatgtttcggccttttttaatcgctattaatgtcatcaaatatcacatcggccaaaatttgctcattttcccgcaaaattctgataatggtgtcactaggatgtgaggtattggtatacctgtaatttgaggaattttaacgaagactgttgactttctgaaaaatgggtatatattaatacccgtaagtaaatgtcacaaaacattacatgaaatgagggaatagaatgagaattgagagagattgcatcggagaaatgtttgtacctgataacgtcctttatgggattcactcactgcgagcgaaacacaactttccaatcaccaacgaaaaagttgatccagccatcattcaaagctatctgcagattaagaaggccgctgctttggctaacgagcaggccggcaccttggataaagaaaaaagtgctttgattatggctgcctgcaaccaattgctattctcaaatgactacagtgcctttatcgtgccagccatccagggtggtgccggaacgtcaaccaatatgaacgtgaacgaggtcgtcgcccagcttgccatgcaattaagcgcccagggtggaaaagagcccttggtaatcaagcccaacgatgatgttaaccagtcacagtcgaccaatgatacctatccgacggcaggcaagatggcgatgttaaaacggttggcgccattgacgtcagctgtttccagtttggttgacgccttaaccgataaagccgcagaatattcgtcagcaatcaaagttggtcggactcagctgcaggatgctgtgccaacgacctttggcaggacctttacagcttatgcttcaatgtttaaacgcgatctctcaagattaaagcacgctcaaaaggttctttctcaagtcaacctgggcggaaccgcgattggtaccggaattaacgcgaccgctgaatacgaatcagccattattcccattctcaacaaatattctcatctttcgttgcatcaagccgctgatttggtggacgccactcaaaacagtgatgctttcaccacgatttcttcggccatgaagtcattagctgctgatttatccaaattcagcaatgacttgcgactactttccagtggccctcaagccggcctgaacgaactggagctgccaaagaaggctgcagggtcctcaattatgcccgggaaagtcaacccaatcatccccgaagttgttaaccaggtggcatttgaaaccatcggcaacgacgtcacggttacaatggctgctgagagcgggcagttggagttgaatgcatttgaaccaatcatgttcaagagtattttgactggtgagcagcatttgaccaaggcaattgagacgctggttgaaaactgcgtcagcggcatcaaagtcaatgcagcatattgccgaaaggaagtcgaacactcatcgatcgcggcgacggtgctttcaccgctgctgggctatgaaaagacgaccgcgttgattaaggaagcattagccactcaacaatccgtcaaagcactcgtcaaacaaaagcagctgctcccggattcattggtcgatagtctcttcacgccagaagttttgacgaatgttcgcagagtcaagaaagaaaagtctgctgccggttcaaatttaaattaaccacgtttcaccgaaagtcagcctgatgagggggggctttttctttttgaccaaaacagaatcatcaccacgctctccaatcgcgatataattgagttggttaggtcaacaatttgaaaaattggggtgatttgacaatgaaacagaataaatcaacgctgattgacgatgatgccaaggctgatcccactgatttgatgaaccagtttcaaaccagtaatggtggtctctcgcaggcagaagccgagaagcgtttaggaaaatatggaccaaatacgattcgacagggcaaacgaaagtccgaagtgttaatctttttggaaaactttacctctttgatggcgattcttttgtgggtatccggtgtgatcgccatgtttgccggcatgctggaacttggaattgccatttgggcggttaacgtcatcaatggttgcttttcatattggcagcagcacgccgctcaaaaggcaaccgactcattgaagaaaatgctgccatcttatgttaaggtccgtcgggatggcaagtctcagcagattaaagttgaacagctggtgcctggcgatatttttgatattcaagcgggggattcaattcctgctgacgccagggtgtttaatgctgccaacctccaagttgacgaatcttctttgactggtgaatcggtaccggttgaaaagcatgacgcttaccaacacggcgatggcgaatttgctcaacagaacatcgtctttgctgggaccatttgtaccagcggcactgcgacagctctctgcttggcaaccggaatggatactgagttcggccgcattgccacgttaactgagtcacagaaaaagaccgtctatccattggaacgggagctcaatcatttaacccggcaactaacgattattgcgattatgattggcgttgcctttttcctgctggcaattttcttcgttaaatatccggtgaccaagtctttcatttttgcattagggatgattgtcgcctttatcccagaagggcttttgccgacggtaactttatcgttggcgcagggcacccaacgaatggcgaaaaaacatgcactgctcaaaaacctgagtagtgtcgaaacgttgggacagacgacggttatctgctccgataagactggcacgctgacccaaaatcaaatgactatcaaccatctgtggctgccaagtcaagaatacgacgtcactggaaccgggtacgtcaccaatgggcagattcagttaaatggccaccaggttgatctggcaggacagcctgacctcgagaagctgttgattaatgcaaccatcaataatgataccgaggttactgaaggtaaagccggtgaaaaatcaaaaattctcggaactccaaccgaggccggcttagtgatcctgtcacgcaaagcagggattgatgccgccgccgaacgccaaaagtttcccagattaaaagaattaccgtttgattctggccgtaaattgatgtcggtcatcactaaaaatgcggacggtaagttggtcatcaataccaaaggggcgttaggcagtgaattaaacgtttgtgaccggatcttagataatggtcatattcgacctttaacggctgatgatcaggctaaaattatgcaggtaaatgaaaattacgccaaacaaggcttaagaaccctggcgttttcgtatcgggtggtggatgaaaatgatccactaagtcagcagtcacttgaaagctgcacgattgaaagtgctgagaagcagatggtcttcattgggctggcaatgatgtcagatccgccacgaccagagatctttgatgctgttcgcaattgtcgacgggccaacattcggatcatcatggttaccggtgatagcccgacgactgccaaaagtattgccactaagattggcattacttcggacaaggtcagagtcatttccggcgccgaactggataagatgtctgatgccgagctgcaggaagccgtcaaaggggaagtcatttttgcccgggttgcaccggaacataaatttaggattgtttccatgtgccagaaaaatggtgacgtggtggcttcaaccggcgatggcgtcaatgacgcgccagcactcaaacgtgcggatatcggcattgcgatgggagtgactggaaccgacgttgcaaaagacgctgccgatatgattttgaccgatgataactttgcctcgattgtcagcgcgatcgaagaaggtcgggccgtttacagcaatttgcagaagttccttctatatatactcactagtaatgttcccgaagccgctccatcggtcatcttcttgttgacccgtggactggtgccattaccgttgacggttatgcaaattttgacggttgatttgggaactgatttactgccggcattgggactgggaaccgagaaagccgagccaggcatcatggatcagccgccccgtccattgaacagtcacttgttgaaccgatcaattatctggaaagcctttggttggtacggcttgattgcctcggcaatttcgacgtttgcctacttctttgtcaaccacgtcaatggctggcctcaagtacccttggccggatctggtttggtatacgcggaagcgacgacgattacattggcagccattgtcttctcccagattgcagcggcgatgaactgccgaacgcagatttcatcagtcttttcaattggattatttagcaatcaccgcattcttttggggatcgtcgtggaagttgtcttagtcgcactgttgatgtatgttccatttctccagggcgtcttcaacaccggaccgctaaacgtcacagaatggggcttcttattctgcattccggtgccgatcttcctggttgaagagctgcggaaatatgtggttcgccagattaaaaagcgacgggcgaagatttcagtctgataataatgttgcatttacaacaaaaatagtttagaatcaattctatcaagaaagggctgattaagtggcagagattttacgacccatcggtgcgattgccagagccttggattcaattgccaacgttgaatttaaacggtttgatcttaccaagggccagtatttatatttggcccggatttgtgagcaccccgggatttttcaagaccaattggcagaaatgatcaaggtcgaccgaaccacggctgcccgagcaattgataagctggcggcaaaggactttgtggttaaacagcctgattcgaccaaccaaaagattcggcgcttgtttccgacagaaaaaggacaggcgacctatccgaatattttgcgggagaatcagtattccaaccaggtggcgctaaagtccatcaccgacgatgaggccgaccaactggaacgccttttgcataaagttagtgccaacattgacgatgactggcattatgttaaaaaaggcaatcttagaaagtattgaggatgaacttgtgacaattgtgattagaaaatgtactttggcagatctttcagaactgcagcagatcagcagagagacttttgctgacacgtttggtccggaaaatagtcctgccaacgtgaatcagtatttggatgaatcgtataatcttgaccggctcaaacaagaactcaccgatgcggattccgatttctttttcgccttggtggatggccaagtagccggttatttgaaggtcaacgtcggcaatgcccagacagaagcgatgggcaaccatgccttggaagttcaacgcatctatattaagccagctttcaaacggcagggaatcggatcgaaattgatggctcaagcattggcggtggcaaaagataaacaccgttcgactgtttggctgggcgtttgggagcataatcttgtcgctcaacagttatatcaaaaatttggtttcaaacaaactggcgatcatgtcttcacgctgggcgagagccgccaacgcgacctcattatgagccgaacaattgaaggagagagccagcattcatgaaaaaattcattttagatcccaaaaccatcgaattatttccagacatccatattgacgtgatgaccttacatggcatcgataatcacgtgaatgaaaaggacgacccgtatttccagaaactcctggatgagggcaccgaggcggccgaacaatttatcaccgtcgacccattccgtgataatccggtggttgccgagtggcgggaagcattccggaagtttaaaaccaagaagggcgcccgctcaacgattgaggccttattaaaacgggtcagtcacggaaaacgattttcaccgattgcaccgttagtcgatatttataacagccaatcactgaagtacggagtctccgttggtggtgaaaacgtcgacgccattgctggggacatgcacctgggagaagccaagggtggcgaatccttcctgccatacggtgagaccgaagatatgccggctttacccggtgagatttgttatatggacgataaaggcgcagtttgtcgttgctttaactggcgcgaaaatcagcggactgaattgaccgaggacaccaccaatccgatcatcgatattgaatcgattaatgaggatcagtcggcccgctcagatgttgccatcagagaaattcaacgtctctgcaaagaatattttggagttgttggtcagcttcaacaattgaatgctgaaaatcctgagattgtcattgctaaataaattcaaaaggcggttatcacattcccttgcttggggatgtgacaaccgcctttaattttggttccgagcttatttgtgatacttgtcggcaatattatacttaatatcaccgctatcaactttcagcaaaactttctttttatcatgcttatcaattactttgaacttagcgtaggcctgattagcgtaaaccttgtggaaagccttcgaacggttacgcgagcgattaaccaaatagttccacttatcgggcttaccagccttgagttctttgactgcttggctgttctgactgaccttgatggtaacgcccttgttcttatcggcttcaacggatggtttcttgccgtagggcgtcttatcttgggcattgaacagatactggttcagttcacgagccaccgttttatgacccgggccatcctgtagggtgaatagactgccgacaaaataaatgacgagcgcggcagcaaccagtgagataaacttgccaaccggtttttggtaccacttcataaattgttcaacatctttattctgaacttcatcttcttcaagccatggctgcttggcgccacagtatggacaaaagtttgagtatgccgggatggttttcccacacatgacacaggacttagtcttttcttcagacatttctcatgctcctccaatatgtacctttgcgaatataccaattaattatagcaaagatttgcttggtgggaacaggtaagtgcaaaattatcgttaattaggcaggtgtttatcgataaattctttcaccggcagccggaaatcgaggtaatatttctcaagatcctctctagaccaattccaccaggcaattttttccatatcggttttaatttcgtcagggaaacgatccttaattggtttggcagggatgccgccgacgatggtgtagggctccacgtctttggtcaccacggcacctgaaccaataacggcaccatcaccaactgtcacgccagcttggatgatcacgccgtggccaatccagacatcgttgccgatggttgtccgcaggtgggttcttttttccaagaattcggtgtctggatgatcgaaaccgtaagcgccgccgttataggcaaagatgtgttgggcaggccggtcgtagggatgattggtcggtccgattcgaatcatcgctgccatactgatgaactttttcaagtcactgttttgaataaaacaatattggccggtgtaggtataatcaccaattgaactattatcgattaaattgctgcttcctatttccacccattccccgaatgtagtattcttggtttgagtcatttttccaatcgttggtttatcttttgacaactttacaaaatcaatatgcatacgaccaacctctttctcaaaataatttctaaaaactattataatatgttttcacactatttagttaaaaggagcttacaaatgtttgaagtaaagactattgatcggtttgacctgaccgattttgctggagacgtctttcgtacctccaacaccgataccccggatgccattttagtgcggagttccaaggttgatgatagcttgatatccaagcgattgctgctgatcgcccgttccgggactggcacgaacacgattaacgtcgatgcggcaaccgccaacgggactgccgttttcaacacgccgggggttaacgccaacgccgtcaaagagctcattattcaaaaccttttcagatgtctgcgtccgctgaatggtgccgttcaaatgatgcagcagctcaaagttgccccgggtgaggatttgcaggccgctgccgaagccaaacggggcgattttattggcgaggaactttatggacggacacttgggatccttggcttgggaacgatcggccagcggttggcggatgcctgctaccacatggggatgcagattatcggctataaccgcagcttcaagaatctacgtcacgtccagcaattggataccattgatgaagtgttggagcaggccgattttgtggtgattttactcccgctgaccgatcaaaccaaccagctgttgtctaccaagcaatttgaaatgatgaaggatagcgcttatctgctgaattttggccgcggcgagattgtcgataatcaggcggtggtctcggccttgaatcataacgagtttgccggttacgtgtgtgactttccgaaaacggaactccaggatcatccaaagattactctgctgccacatttaggcggcaatacgattgaggcgctgacccattctgcgaacttgattttgcagaacctgctggactttttggaatatggcaccgtcagaagctcggtcaactttccccgggttgatttgccgttcatgagtaatcaacggctgacgtttttcttccacgccagagacacattctgggtggatgttgccggtattatgagtcgctatgacttgccggttcaagaaatgatgggaaacaccatggacggttatggctatacgattgtgaataccgatttggcggaaatcacgcagcaacaaacacagactttgttaaatgaacttaatcagattgacgggatgattcgggtcaggttgttgaacaacccaacccagggagaatggcagtaaactttagtaagtgtttcacaaccttcgaatttttttgaaattatgagactgaaagtgggagtacgggtctcgtgatttgacgagctcgtttcacaaataaaaagcaaaagaagtattgaaattaattttcagccgcctataataagcattgtaagcggttgttagttgaaaaaagcaaatgattaattcacatattcgcactcatttaagcgctggataatcatttgcttttctgttgtttgcaattgctcactaaataacaaatatagtatttggagatgtgattatgcgaattaaagcagctgttgttaacaaaaaaggcggagacttcgaaatgaaagatgacgtcgaattagcagatatgcaggctgacgatttacaagttcatatggttgccagtgggatctgccattcagacgaagctttacgaaaaggaactgccgaaattggttacccaatcgttcttggtcacgaaggatcaggaattgttgaaaaggtgggtcctgaagttaaagacttcaagcccggtgatcacgttgttctgtcattttatggctgtggcaactgtatcaactgtttaaagggaattccaacccaatgcttgaattacgcagcaaacaacttgtcaggtgttcgtcctgacggtagtgcccactttactgaaaatggtcaccaagttgccgacatgtttgaccaatcctcattcacgacgaccactgttgtccgtgaacgtaacgcggttaaagttgataaggacttggatttgcgtcaattaggacctcttggctgtggctatgtcacaggtagcggcacggtcttcaacactttgaagccggaaccaggttcaaccattgctgtctttggtactggagccgttggcctggccgcaatgatggccggccgaatttccggctgcaccaaagttattgccgttgatatcgttcctgaccgcttgaagttagccaaggaattaggtgcgacagataccattaacagtaaagacactgatccggttaaagctattcaagatttgactgacggctatggtgttgactatgcggttgataccactggtgttaaatctgtcatggaagcatcaatcaaggccttggcacaaggcggcaccactgcaacaatcgccgttaccgaccaacacgttgatctggatacttggaacgatctatgtgtcagcgaccggaaagtcgttggtgtcaacatgggtgactcaattcctcaagtcgatatccctcgtttgatcaagttctacaagatgggattgtttgacttcgacaagactgaaaagttctacaagttcgatgatattaaccaagctaacgctgattctgtcagtggtaagacgatcaagccagtactggttattgacgaagactacaagcctggtaagtaacacgtttccacaaactcacatcaaggcatccaaaagtttcattaaaacaataaaaatatttgttcctgccagatggcgttcaattacactgttttcgacaggtatcttgaaagggagcaactattatggcacaaaatgctgttgcattaaaacattatcaaatgtacattaacggaaaattcatggattcaaagtcaggtaacgaaattactgttttaaacccatcaactggtgagaagatttcgacagttccagctgcaactcgtgaagaggccaaagaagccatcgatgctgcatacgaatctgaaaaatcatggaagaaagttccagctgctacccgtggtcaatatctacacgatgttgccactgaaattcgtaacgagaaggatcacttggttgaaatgctccaagaagagcaaggtaaaatcaagtcattagcaaccactgaaatcatgttctcagctgactatttcgattacatgggcagtgctgctcgaacttatgaaggtgaaattcttcaatccgacaacaagaatgaaaatatcatgattgccaagcagccaatcggtgttgccgccggcatcttaccatggaacttcccattcttcctgattgcccgtaaaatgggtccagctttggtaactggtaatacgattgtgatgaagccatcttcagacacaccaaacttgggacttgaatttgccaagattgttgaaaaagttgggattccaaagggtgttgtcaacattatttcaggtcgtggctcagttgttggtgacgaacttaccaagaacaagaagatcggcattattagtttgaccggttctgttgattctggtaaacgggtcatggcaggtgctgcaacccacatggctaaagtttcattggagttaggtggtaaagcaccagccattgtctgcaaagatgctgacattgatttggcagttcaatcaatcattgactcacgtgttgataacaatggtgaactttgcaacaactgtgaacgggtctacgttcaggaagatgttgccgatgagttcatcaagaagttatcagacaagatgtcaaagatcactgtcggtaacgttatgaaagatgaaaacgttggtatgggtccactgattaaccaagaagctttggacaaagtctctggcatggttgatcgggccgttcaagctggtggcaaggtcacagccggtggtcacaagttgaacatcgaaaatggcttctactacgaaccaacggttatcaccaacgtcaaacaagattcagaaattgtgcaagacgaaatctttggcccagtactgccagtattgacctttaagactttggacgatgccattgaaatggctaatgattctgacttcggtttgacttcatcaatctacaccgagaacttggacaacgcaatgcgtgctgccaacgaactcgaagatggtgaaacttacatcaaccgattcaactttgaagctatgaatggttcacactcaggctggaaagaatcaggtatcggcggcgatgatggtcgtcatggtatcgaagaattcttgaatactcatgttatttacctgcaagggcatccggagaaggctgaaggctagagcgtgacgagggccgggagaggcggtttctaagggtactttgattgaagttcctgggtttggaactttaattaaagtgcgcttagaagttagcctctggcccgtcggagcacattttatccaaataacagtgaaccacccaccaaaaaggcacccacagcaaacgcacaagaaagtttgtcggtggatgccttttatgtatgactaaaatagctgaaatccgaacgaatattaaccgatgtgataaatagaaaaaatgacactcccacaccatcctggcatataataaagccaacaaacccacaggaggcagacacaatgacaccatccaatatcatcggcgggatactaacatgtggtgttggcctatttttgattgtcgcaggcttaatggtgatcaggggaaaatggtcaggaatcgttgctggaaatcttttccgcgatgatcaaaagtcggttggtcggcataagaaagccattggtattttatatatcatcctcggcgtcctgtgcctagtcttttattttgttgtctttttgaaagcttgaaggttcatatcatatcccatcaaaatagcggcctgcactggtctcaaccaagcgcaggccgctatattatacatacagtaaagattgaatcattgaaccaggtaaaagacgccactgaccccaatcaacacaaacacgcatttttgaatcattgagatattcatgtggaccgtaatccggttggcgatcatggttccgatcacgccaccgacgattcccaacaatatgagggggacgtcaattaaacctaaaataccgttatagaaacgaatacttgtgatatacaattgatcaatcaagaagaaagcctgaatactggcgagatattcctcttttgtatctgccaaggacaggaagtagagcgccatcaacggtccaccaattccaaacaagccgttgaagaagccggaaacgatcataaagataatggcaatataaatgggataatgtttccggccttctgatttgacgaacaaaaagtacagtgagagggcaaccaacagaccacccagcatggatttcagtaaatggacattgattgagttgactagttgtaatgccataaaggccacactggcatagacgacaaacggccagatgattcgtttgaattggatgctgtgccgataacgccaagccaacatgatgttggaaaccgacataatcaaggatgcgaccccggcactttgggggatgggcaagattgtcggtaaaaagaccatcaagacaattgctgagccaaatccggtaaccccctggacaatcccagcaaggacagcgggcaggagcacgaatatgaaattagtcatgaccatcctcctctcaagtcatctccgttacgagacgtgtgataagttcctctgaggcttccggtgaagctttggtgattgtttggtgtaaagttttcgggacataaagagcgcgacgaccaagaaggctaaacacatggtaaagccggcctgaatgcccatttgttgataattggcgtggccagcaaaaaagtgactggcaatgttgatggtggccacaataatggccgttccaaacgatgccgcgatttgtcgcaaggtgttgaaggcagcgaccccgtcagcgattagttcattggggagataggatagtgcctgggtctgaattggaatgagaattaagaccagtccaagctggcggattgtctggcccattgtcaacatcagcaccgaagcgttaacgtcaatgaatgcctgcatcatggtaccaaaacaatcgattagaatacccgtggtcacaatgatccgcaccggataacgatcgaacagccggccactgattggtgacataaaaccagttagtagcgctcccggcagtaaagagagtccggagatgatggcactcttacccatgatcgtttggattagcagcggcaacagaatcgtattaccatacatcgtcgagacaatcagtgagttgaccaaagtggcagtggtgaactgactgtttttgaagacggccaaattaacaaacggatggtcggattttccttgagtgacggcaaacatcgtgattaagacaacaccgacgacgaatggcagccagactgttagagatgtgatagggaactgactcacgtttgaaaaactccatagaagtcccagtaaaccaaaactgatggtcatcaggccttcggtgttaaattgaggttcctggttagtagggatcttgggcagggcaatcgtggccattaccaaatcaatgacgataaacggcagcaccaaaatgaataggtagcgccatgagaaatagttcaaaataacaccggaaagtgttgggccaatgatcggcgaaaagttaaatgccaagccgacgattcccatcacggcaccttttttgccgggctcggcgtagcggattgccagggtatttaccaggggcatcatcattccggcaccgattgcttggatcatgcggccgatgatgagagtgaagaaattaggtgccaaggcaccaaaaatcgttccaactaaaaagacgctgacgaaaaaaataaacagagaacgaaatgtgaacttcttggtcagataagcactgaccggaatcataatcgcgttgaccagggtgtagccgttgctaatccattgaaccgtaccggacgaaatggcgaacaccttcataaaggttggcaaagcgacattcatgagcgttgaacagagaatgccgaagaaggcaccgaagatcataatgatgagcgaataacgattttgctttgacattaacaggacttccaaatatgtattttttgcatttcgaaaaatagcaactctaaatagtgtaattttaataatggataattgcaataggaatatagttaatcactaatcgcagaataaataaaaacgtggaattgtaatcatgcaattccacgcttttattaagctttcttagatacccgataaaagttcggtgaaaatggcgtttctgccgcaatgttactaccgtcataatacacgtgaacgtatccgtgaccaactcgtttgaaagtgaatcgggcctggtgcaatttgttcagttcgtttctgccgacgatggtgtaggcggttttaccaatcgctttccatttggtatcggtaatgtgccagcccgctgactgcgttaaataggcattcacactacttttacgaacccggacagattcatagctatcaaacttcttcatgccaaagtatttaccgatgttaatcgttttgtctttccagtgaccgcgtagtgctgttggggttcccttgtgccaggttgccgcttgtgttgatgtcgttactgctcccaaaaagccaagtgacgcaatcgccgttacgattaactgcgtgcctttgttcatgactgtcatctccaattaatttgcttggtcaaatttattaaccaattgaatgaccatgcttggctcactgccggggactgcccgatagacgacgtagtctcccggaaccaaatcaacggatgccagctgggctttttgggcgacgctaaagccggccacttcgtagtaggcgtgaccgtcgacgtcttcgtcggttaacgtgacgttgacctgttcgagtggggcaacgtctaaggatgcccggcgtaatgccaggtactggtagttgatcgagtcaaccataatggtgatttcattgttggtgcagggaacgctcatggtctgtttcaaattgatttacttccttctttgagtttcgcgtggcgaatatcattgacattgatggtcaccagcttgtcggtttgaagatagattagatcaccattagtgccaattacaatgccacttatattataaacgtttaagtagccgtcatcatttaattgaagggtaatttgtttggaattctgccaactgtcctgcaaaacgcggtcgatgacttccggatcctgttccggcaatcgatgagtcgggacctcgtcgacttttttgtcagccatatcctgggtatggtcactcaaaaagtaacccagccacttcaccatgccgcggtcgttgtagagccattggtcgcgtggaacgtctcgaatcatgttgaacacccccatacgtttaatatacgaacatatgttctaaacgtcaaggggaacagtttaaataaatgaagcctggagccgaagtgattgctggccttgggattgggaaaatgttacagtttatttggctaattcacaatttattcatatttttaggggacaatgaatttataaaatacattgaataggagtgaagcaattgcgcacggtctatattttcaccatcattattgcgtcgatcgtcatgtttttgattgattactatgtgtcattaccacatgtattgtgggcttgtacctggttgggattcattgtaatcgttggaatttgcagttatcaaataatggctcattggcataataatcaataaaattaaattcgaatttgcttctcatccgtcgagatcgggaagcccttcttaaacgcagtccgcaagaagttaagcaggggcggagttacctttaattcgtccaaatcccgcaatgagaaggtatagcgaattgccttttcatcaccagcttcaactttttggacccacttgggctcacggatcaactcacggcccatggcggcaaattggacgccggcgtcaatcaacttggcaacttgagctggggatgccaaatggccgacaaccatcaatggtaaatcatccgccaggactgcttggactttttcgaagagcggctgctggtcatcgcgatcgacaattgatccctgccaggcatccgccaatgacatgtgcagataatcaattggcttttgattgagttctttcaccaaggccagggtgtcggtcattctgataccaggcttttccagttcctcaggcgaaatccggtagcccaagataaactttgggttatcagaacgcttgatgacggctgcgcatgcatcaacaaccgccaaagggaagttcatccgtttttccaaggagccgccccagtggtctgttctgcggttggaatggggactgaagaattgctgaatcaaataggtgttggcaccgtggagttcgacgccatcaaaaccggcgtcaatggccaattgagtggcgttggcgaagtcctgaatggtctgctcaacttcttcagcggaaagcgcccgaggggtttcggcacccaagcgttgtggagcgaccgcgctggcagagacggtttgatggccgcgcagtacccgcgagttactcattcgaccggcgctgaagatttgaagaattgctttggtatgattgattttgatggcgttggcaagccgcgacaacccgggcagcatgttgtcatgtgcgacactgagttcgccttcaaagcctttgcccagatcattgacgttggcgcagccggtaataatcatgccggggccaccggcacgcaatcggaagtagtcgatttcgtctccggtgatcgaaccgtcttcaaaactggacatctcggtcatcggtgacattgcgatgcgatttttaatggtgacaccgtttcttaattgggttggttgtaggaaattatattttgtcatatgagacctcctgatgatgattaataccttgagtgtaccaaacaaacctaaaatttccaggtgaaaatgtttggttcattttcctaaaaaagcgtttacaatagaagtggaaacaaaattggaggagtgatagttgatggaaacattgaaaatgattcagtcacgtaaagcagttcgtgagtattcgggccaagtgtccgatgatcagctgcacgaaattttggttgcagccaacgccagtccggttgggatggggcgctatgatgattatcgattgacggtgatccaagatccaactgttttgtcaaaaatgactggcatttatgaagccccaacggtgattgtggtttcagtgaaggaagagagtgcctccgatgagatttcagccggcgcgatcgttcacaacatggaattggccgctgaagatcagggattaggtgccaactataatatggccagtttggaatccattccaagcggagtcgttccagatggttttaagccggcatttgccttgacccttggccagaccaacgatacattcacaccacgggaaattccgttggatcggattaagacaaatactgtgaaatgatattcaaaaaaatgggttagctctcaacgatttgttgggtgctaatccatttttgatttgacagttaagctggggattctttatctgacgaattgcgggtcgtggaccggttataattccccgcctttttcaaaggttggtaccatcttttcagctcgcagcaacagcaattgatgcagcaaatccttcacgttctcagtaattgcgtgagcgatcttgtcgttaacctgattatgccactcaggtaacttgtccttggcaatgtttttaaattctgcatctgcagtcgccactgcagcccggccgttggcaaagccaaacttgcggctttcagaaaccgcagtcattgcttcgagatcatgctcggcaaagaaggggtcagccaacatggcaaccaacttattcagccaataaaagctttctgtcgtggttcgcagcggcgtgtgcttaaagttatccggggtatcagtgcagttggcaaagaatggtactggcgcgttgaactcattgacaccttcggccagccaatgaatggcggcgtgttcggctggaaaatcgggacgaatttgcaggatatgtatctcttggttgcggttcataccaattggtcgatagcgcaaccgtgattcttcagttccggtcttcccataaggatcaaactcggtgccttgatagtggctgctcaaaaagaaggcaatgtcttcaactgaaatcaaatgatcggcaactctggtaaatggcattgtccgactttcgggattctgctggatttccgggttaaacattttttgaccgtaccaaacccgcggggtgttgtagtagtgatccgcttgaacgtcctcaccgaaaatatcacggaagttaaagccggaacgggccttgttcaagtgatacttatcggcaaatgctttcaggtcgtcgctgtacatatagtggtcaggatcatcaaagttgatttcttgaatgccggtttgattaggtgcgaccgcataagcgtcatccggaattcgttcggcagcccaatggtgcccaccgactgtttcgaagtaccagacttcatctgaatctgaaaaggcgatgccgttgctttcacaagtgccaaatttggtgaccaaatcgctcagacgtttgacgccttcacgggcattatggatgtaggggaggacacaagtcagcatggcctcttcaccgataccgtcagccaccagcgggtccaaccccagcatggtggtgttggtaaattcggtttcagttgagctcatggcaacgttgtcagtgttaatcccggattcgccccagaggccatcactaacgtcagcgttgggtgtttcggtgtagcgcagcggattgtttgggagcttaacccgaaattggttaaaggtcgaaacgtattcgctgggttgatctgtcgggttcaccaccacaaagcgcttggcattcacgcctccgccggcatcttcatttctggcaatcatcgtcgatccgtcagttgtagcattctttccagctaaaaatgcggtacagctggaagtcgtttgaaatttattcaatcaaatcattccttctcaatttaatacatcgattcgattgggaagcggtgcttggtacggtagaaattttagtaacttaaagctaactggttggtgattgatttaggaagtaccagtgcttggccgtaaatccaatatttttgaactttggtgtgtttagtggccttcttggttgagtatttggtgatccggtaccagttgaactgcaatccctggttggcgtacaaatcaacgtggactttggtgccagcctttaagccgctcttcttccatgaagtggttttaatgtttttgtagctgctgttgggggcgtgattagtgagcttaaatgatttgtagttggtgccgattttggcattaaaattagctttgtgataactcaaggatccgggcatgctggcagcgcttgaaacgggggattgagtgacagatacgagaccaccaaggcccagggctgttaccgccaacaagatacttttcttaaacatctaaaaaatctcctttcaaaattcaactaattttagtataaaagtctggttaaaaaaattccagccgactagctggaattttagtgattagcctaagaacttacgcaagattgcctgacgactgattaaggtggtcttggtttctttatcagaaatcttaaccagatcagcggctagttgggcatgcttctcttgttcaggtgtctgtgggccggcctgaatatcgaatagtcgttcaactgcttcaatatcttcgtcaaccgctttccaggcagggttcttggcttgaagagcagtcaaggcgtccttgctgaagtatttggcaacgtgggcataatcgtgtttgatatttggatagtatttcattaaggtgttcagttctttgtcactgagcttgttcaagatgcggccagttccaaggaattctggcggaaccccaactgagtacagggcaccggtaaaggtgatcgcacgaggcatcttatagccatcaacgtcacgtgagtaaccgatgattccgacgtgttggtgacggtcccgacgctttggaaaggcatcaaataccggctgtaagtcgttaatgagtggatccaaagtttcgtgatattctgcagcggcttttttagcgatttccaagagaatgtcttggtcgtcgtgatcgataatttcaaatttgctcttttgaaggccgtcgcgcagtttgatgatcgctggttcaaccacatccaatgggtaatcgtaacggaatgccgattgaatcgttgccgtcttcaaaccggggaattcttcgaggtaacggtcaatcatcattggtgataggccgccacggaagatggtgcttccggttccggcaattggatagatcggcaagccagattcttgttcaaattctgccaagccggtcaaggctaatttgttaccaatgatactgttcaagaaaccgtttgaaagggcggaatcggatcccgccaagaagacccgcatgtagcttaattcacggccaaagtggtctttgtacatttcaaggtattttttcaggatttgtggggcgtgtaactgggattcgaatccttcaaacaatggaatcatttgcagagtatctgaatctttgtgcccggtattaaattcagttgacttgtagtgggaaaggctggcgaacttgtcttccatggaaatcagctggtcggctgattgggtcatgggcaagatagcttcgaataacggtcgttccttgaatcccaaatcgtaagcaaagtcttcagcggacaagatggtggtcattgcctgcatcaaactgtagcccttttcttcccaaatgtttggcagacggaaagtgaggtacttatctttgccaaggggatgcttttggaaatattcgtagtgctcggagtacaaacggtcaatgacggatgcatcggcgtgtttgccttcccagtcccacatatactcatcggcatcgagcttggaaaagttttggtaagcttcatcaatttcacgaaatgcggatacaaatgcattatcgttgtgcttgaagaatggaactcctgcgttatctggatgttgagtacccataatattagggatttttctatccataaaagaaagcctcctgagatttgattaagttcatttagaatgattatacagtaaaaaatgtgaacatgaaaataatattagcaaattgtgcaaattcataaaacaattaaatacccgaatattaatgaataatttaaacagttaattaattatttcaactaaatattacagcttatttgaaaacattaccagctttttagatgagattgagaacattatcgcaatcaaagaggttgggacattaattgttacgctggttttcattgcaaccttcattaccacttttatatagataaaacttgcaacaaacggctgatcccggccatttaacgaataaacgcagtcattccaaagtccggaataactgcgtttattcgttaaattctgggatcaaatcgcctttcgtcccaatctctttgggttaatcaaagctcgtaactgtttcagcggtgtagttcccgctgttcttaagtaattttgaaactgggcagcggttttcagcttcttgtgcaaattgatcagcggtttcaaagtcaacacctttgaccatgatctgagcgtgaactaagaattggtattcagcccgctcaccaatgtaagccactttgacgtggacctcggcggtgtgggggacaccatgctctctttcaacggcttgaagggttgcctccaagcaggtggccaaagacatgcccaaaagttgttccgggttggtgcccggctttgaattcaatgggctgctggtttccactttgatgccatccggcacataagcatggccgttcagaccttcatcattcacagcttcggtttgatacaacgggttattccatctttcatcttgcattctgttagtacctcctacatttctttaacctcgattataagcgctttcaatgaaattaaaaagaaaaaggttggtatcaaaaaaagagtgggactaaaggcgttttgatcccagaatttaagcgcacagatcgattattcctggttttggaatgattgatctgtgctcttaaatggccgggatcagccgattgccatgtaggctaggcaagcatgctggccgtcgtcgcacgtttttgataaataatatgggatcacaaaaatagaggccgaggcaaaagcgtatacttttgtcccagcctcttgagccgttattcgttataatccattcgaatgatcacaggatctttagtcaaaaagtcgccaaccccggataaaaatttttggaaatggggcgtattgttgtggaattcaacagctttttcatcctgccaatgttcaataatttcatactcagtgtcactatggagcttcttgaaatggtcgtagctgacgttgcctgcttcgccacgggagccatcgaccaattcatcaataaatgcttcgtagtccgattgcatccctggtttaactgacaattcaacgttgataactttcatctttgcagcctcctatcaaatgtttgggcatgtacacccttagtatatcgaagttttgaacttattgttcaatttatcatccgtaaatgtgagatcgtacgccgtcccgtttttatcggtgacatagagtaagtatttggctgacatcggtccctggccgataatcgactggccgtttggtgtgcccaacgcattaatcgcagcttgatatgtagttccaagacccaactggttaatttttgatttggcagtgattcgctgcttgcgcttggcagctggcgtataggatttcccgacagctttgtgattgagaaactgtactttgaccttggcaaccgggaaagtcgcagaaacatccttccaggtatactgcgtcgtcttcttggtgacgccgttgacggtgaccgtgccaacgtgggaaggagtcccgaagagtttgaggacttggtcttccgaggaaccataggcggcatcggtaatgtcgccaatattaatccgattaaaattggccagattgatcccttcagcttctcgatcgtgtttatattcggcggcggttttttgactgtcaaaatgatgatcaacctgttttttggctgaattcgaagtgccacacgctgatagcaacagtgtgctcattaatgcgagtgtaactgtaattggttttcccataaaattccccctgacaagatggttctaaatgttggctggattgacaacattatatacttatttgggcggcgagtcgtggactttttaaccgtcgcggccagttttcgaatataatgaacatacaaagttctcaatgaaagacaggtgaatcaattggcaaatcaaccgttagtatttgattatcaagcggctcaaggcaagccggagaatattcgccatccggaagggtactgcccgttttgtgatgttgagcatttgaccaacattttggcacaggacgacgatcgaatttggctggtcaataagtttcggacccttgaagatacctttcagactgtggtgatcgaatccagtgaccatcttggcggaccctccacttattcagttgagcagaatcgtcaagtgttcgaatttgcgtttaaatgttggcaccaaatgattgtgtccaataaatatcaaagcacgattatgtacaagaactatggcccgttatccggcggcagtttacgacatccacattttcaaattgtcggattggataattatgatgtttatcaaaatattgatatcagtaattttaccggagttgaagtgattcatgatgagcgctgtgaaatcacattatccacgcaaccgattattgggtttgtcgaaatcaatattgccatcgacgaagttggtcatattgacgatttggccgatgctgtccaagtgattgtcaaatatctgttgaacgattacatgggtggccggctgtcatcgtacaacttatttttctacgaaatggccaataaattttactgcaaaattgtgccacgttatgcgacctcaccatattttgtgggctataaaattgcacaagtccaaaatgaaggccgactggaaaaaattgcggcagatatttcagaacgtctgtcggctaatcaataacaataaagggaacggcattttgccgttcccttttattattcatgaagttggttaaaccgcactgactaatggaaccgatggatcgtcattaacgacagtcacacgggtatcctgggctaatgcctgcttaatcatctggttgattttagtgtaaacctttggatccgcagccttgatttcgttacgggaagcaacgaataggtgacgaatttctctggactttaagagattttcaatattctggaagtcggtgaatagttggtccttaaatatcttggtaatggcttcagctgtgttttcacggttgtaggtctcaatggccgtgttcaccaatttggcaatctcagtggtggtgtcattttgaacggactgatccacctcgaagtcggctagttgtaagccattattgactttcttgaataggttaatattttgagataggcccatcaagacgaattggtgttgtgccaattccacgtttccctttaggaagtccattatgacccggtagtaacgttcctggtcgattttcttttcctgggtggtttcgttatgaccgtggtattgggcgttgccgccgcgggcactaaagttcagttcaccgccacgcaattcctcaccgagggcttctttaacattggctggatactctttgacatcaagtgcggtgacccgcttgttggaaagttgatagagtttactgttgtcacggtttaattcgatcaatgtgtaatcctgattaggtgcttcactgagtaataacaggaagtcaattgcatcttcaattcgatagtccggctcatcgacactggttcggatcaaatgataaacatttttgccaaggtgatcggcaatcaccgtcatgccttcataaggcagctgctcacgggtcaggtcattgacatcggcaataaatggcgcaatatcgtctccgacttctttttggatttttttcagcatattcttaactcggagttgttcactttggtcaaacgacagcttacgcaagttaagattcaaagtaatcaccggtgcttgtaagtcaggtaacttcgccaaatctgaaacagaaataatagttgccataagtaggacactccttcattttttatattaggtataactatttaattatataacctacttctattataacagatccaggatccaaagtcttattcggcgatttgataaaaaaagcaatcctcatgggttcaaggattgccgtattggagattcgtaataattgacattaagccgccaaaaagagtgaaaagtagacttaatactgccagggcgacgaacaggtggcgccatttgaaaggtgccggctggccgcgggcatttttataaatgagataaaaggtaccaacgacgatggtaaacaccgctgtggccagtaaaatccagacaactgctaaaacaatatccatgatagcctccgtcaatgatgatacttgtaaagatagcattcacaactggcaatggcaaccaggggatgatcattacgtttttctaaaaccgattatgatcgcttaaggtttaagtttcagttaaccacgcctttctagaatgaatttaacaaatgaaatttagtcacgaatttgctcgaagaaaggtgggagacgatgattaaatggttgccatatttattaaatattactggtgtattggtctggttgaagattcaatcaaggaacttgaggcaattgacctggtgccaactgttcacaattgtcacttcaatcatctatattttggttgtgagctatcttaccttggcgccgacatcatacgcgttcgtgggaccccaacaagtctcaccgatgatgatcggttcggcacccattaatttgatcccattttggagtaccactgctgatttttatcaaaatgtggttatgatgctgccgatgggcgtgtatttgggattgctgctgccaaagttcaacctgcgaaaagtcttattgaccgggttgagtgtcagcttgaccattgaaagcctgcagttcgttttggatctgtcggtcgggctgtccagatgggtcgatattaacgacgtgttgaccaacacgtttggggtgatcgtcggctggctcattttgaaaggcttgatgcacacgatctttcagcgactcttgagtcattttgcgattacagcattttcacaccaaaagggtaaatgattgccctttcaggagtgaggcactaaaataagcttactttaaattaatgggagatgttatgatggctaaattgaaccaggcaatgaaagacatgattgccggagaattatcgtatatttcaactgttgatgcagatggtaatccagatgttggacccaaaatttcgatgcgggttctggatgatgagcatctgatttataacgaaatgaccggcggccaaacccaagcaaacatcaataataacggcaaagcaattgtggccgttgccaacgccaaggcattaaaaggattccggttcggtggaacggcgaaactctacacggacggtgactactttgatcaagctgccaaatgggcagaaggtaagttcccagctcccaagggtgccggtgtgattaccattgaaaagatttggacattggatccaggtcctaaggcaggaaagctatttgaagaatagtggcctactttactcttaaataataaataaaaccagcaatgatgattatttcatcgttgctggtttttgtgtttcaaggttacgtgcaaataaagactattatgcttgttattacgagtcaggcttgataactgatactttctgagaaacttgatccatcagaaactgtatctaaagattttgaatcgtcagactcatctgtaatgatcttaatacttttgggcttcagtgtcgtagtggactcagataataagactaagtcatattccacccgcttggcatggggagccaactcttcttcagaacctgtatcagccatcgcatcgtcatcgaagtttatttgataaccgttggaaaatacaatttgcttgattccgccaaagtcaatcgttgttgtggaatgattggtaacaacatactcaattttcattcgcgtgtagtctttaggcatactatctttgttaaacgaagtcagtgcctgatcaagctgatcttctgtatttgcatgaactttgtcgatctcagcgtgtttaaatttaacagaaagcggcccattttggattgtcgtatccggtttagttcctagtccggtcatggaaatttttcctagaacttcgctatttttccattgcccaacttttgacagatggataagagggtttgaagagacttggtttggatcctttttcttagccttcgctttggtcttagcggtcttcgaactcgctgcaggctgcatgacaaccgttgttttcgcactattcaatagggcgatacagattaccaggccaactcccaatacgataatggcccaaatcatccagtttttataccaaagttgtctttgagatgctgccacgggtgtccgttgctttaaagtgggcgatggtgacgatggttgattttccaatcctacttgtggtttgccacagtagggacaatacgatgcagcaaatggaatctctttgccgcaacttaaacagaactttgtttcttgattcatgataatcccccaaaatatgtattcagctttttgcgtcgtcagttttggacaaaatgactcaggagcatgactggatgcttctgagttttcaagtgcattcagctggtcgttgaaagtgccatttaactatacccaaaccgcaatacctgcgtcaactactttttgacgattatttaatggtttgatagccggaaagttatattatcatctcttgggaatccttttataatagccgattaaccgctttcaatcaaaaagtcgttttaattgtattttcgattgcacaaaactaatatgatgttaatcagtaattggttacttattttacagggaggttttaattatggctgaaacaattaattcggggattgctgcattacacacacttgagagctggggtgttgatcacatctacgggatcccaggcggaaccattaacaatttaatgtatgcattagatgctgaaaaagacaaaatcacttatgttcacgttcgtcatgaagaagtgggtgccttggctgccgttgccgattcgaaactaaccggtcacatcggggttgcctttggctcagccggccctggtgccactcacttgtatcaaggggcttatgacgcaatggctgacaaagttccggttctcttgattgttggtcaaaatccacaagctctgatgaaccaggacttcttccaggaattcgatgagaacccatggtttaaggatgccggggtttatgctcgaaccgtcatgactgctcaaagtctgccccacatcttagacgaagccattcgtcgggcgtttgcgcaacacggtccagccatcgtcacgattccaaatgatttggctaacaaggaaattccagcagatgggtattatagttcagctgccaattttgccaaaccagaactaggtgccggttcagacgagcaggtccaacaagcattggacttgattgatcaggctaaaaagccagtcctgtacgtcggccagggaacttacggcgctgccgatgaggtaatggagtttgccagaagttccaaattccagtgatcacgaccgcactgggcaaggaaattatcccttatgactttgaatccttactgggttccgctgcccgggttgcttccaagccagccaacgaggcgttacagcaaactgatttgatgctgtttgtcggctccaactatccgtttgcagaagccatgttcaaaccggacgttaaattcattcaaattgataacaatccacaagtgcttggcaaacgtcacaagacggatgttgccattcttgcagatgccaagaagacattacagaaattcatcgatatgggtcaaactaaagagccatcagattggtacgcagccaacgttgataacgtcacaaattggcacgaatacaatgaccatatgatgaaccggacggaaggcaagctgcgtttcgaaccggcatttaaagagatcaatcggatcgctgaaaaagatgccatcttctccattgatgttggtgatgttacccaaaatgctgttcgtttgttgaagaccaacggccatcagccttggattacttccggattatttgccaccatgggcgtcggattaccagggtcaattgctgctaagttgagctacccagatcgtcaagtattcaacctgaccggtgatggtgccgcagctatggtgatgcaggacctgagcacccaagttggctacaagctgccagtgatcaacgtcgtcttttctaacgaagcactgggcttcattgaagatgagcaagaggatgacagtcacgagtggttcggaattagtttgccgcagaccgatttcgccaaggtcgccgaagctcaagggatgcttggaatcacggtgacatccgttgatcaaatgaagccggctttcgataaggccgttgaagagaccaaggccggtaaaccggtgctgatcgatgtcaagattaccaacgagcgtccgattccagttgaaaaattgactttggatccggataaattcgatcaaaagacgattgacgacttcaagaaacgttactacgcagaagacttggttccgttgagtgcctttttgaaacaacacggagttaaataaatcgttctatagctaagtgagaggctaaagcatcagtgtcaattgatgttttagcctcttttgtgtgtcattttgatactgattaaatatgctggagatgactgttttcattcacaaaagattaaaaggcctcaatcatgcaagccggataccattgaattataattaattgtatataaatgaggggagtcaaagattatgggaaaatggaaaagtgcactcttagtgctgactggattcgtaactttgggggcagtttcaacgacagcttcggccaaggcaaaacagaccccggtgacggtgaatgttgtctttaatgttcgcgaccgtaatgcaatgaatacttatgtcagccaaacggtagatccaacatccgctaattatcatcagtacttaacaccacaacaggtggctgaccgttttggccgaaccaacgccgaaatttctgattttaacaggtacttcagtcaatatcacctcaaatcggcggcttatcctggcaactttgtgatgaaagtccagggatctcaaaagaatctggtgaaggcctttaaggcgaccccagccaagaccaacaaggactgggacgtgaccggcactaaattgcctggtaagctgtccagtcaagttgcgtcagtcttgggattgtttgttgacaagaaaaagacttcaacgaagaccgacaagaaggcgttaaagtttacccataacttaattgaagacgacacgccaattgtcgccagcagtcaaaatcagctggcgaagaaatatggtccgactaagtttgctgatcgatatggggttaataagctgtacgaccagaatctccatggagccggccagcgctttggggtgattgtgacttacgacttcaacccaagtgatgttgccgactactggaaacaaatgggggtcaacagcgacgtttccagaattcacaagatttacaccaccgataatactggtgggccaaagccaaagaacaatgatgatgtgacctcccaggaagaagccagtttggatgttgaacaagccggaggaattgctgatcaagcacaaatcgacgcttatgtcggggtttccagcaacggagacaccacgccggatgttcaatatttggacgcatttgccactgcgattggtgataaccgtgacaaacaattgacgaccagttcgtcctttggtaatgaattgaatggcttcggtcgtggcgggctgagtgaaacagcttcagaattcaatgatgctatcaacctggtttttgagcaggcagccattcaagaaacagtcatttttaacgctgccggtgacagtggaccgtatgaagtcgcaaataagtcaaccaacttgccattcccaacctcggaatatgccgttcaagtgggcggaacgacgttgccttataccaaaattattggcggccaattggttcaagttaaaaaggagcgtgcttggggtgattcctattcacaaggtacggttaccaagccaactgtcttccctggtggcggcggtggtttttcaactctcaatccaacccctgcttatcagcttggtgttccgggcgtcaacacttacaacgcatttaacatgttgaaatataccaagggtggttacttggtcaacccagatcctgaaatgatttctgggactcatcagggacgaaatgtaccggacatttccgggaacgctgatgaaaaaactggttatggcgtatacattacttataaagccgggaatacccaggttcccatctggatgaatgcaggcggaaccagctttgttgccccacaaatggctggcgccagtgctgttatcaacagtggtttaaagacttctgccggattctggaacccacagctgtataagtttgctgttcaatccgacacaccgttccatgttttagatgacgcgacgatggataataccaatctgtactataccggccagccgggcaaggtttataaccaagcaactggtctgggaaccgtcgacttcagtaaactgtttacgaagtttaatgctcagcaataaagcaaattgaaaaaacaggacccccaacatgcaagatgatagcgtgttgggggtcctgtttttttggatatttggctgaaaagtcgacttatttaatactgtaagtttgtaccccgatgatttggttggtgccggctttcacgccgtggatcttgattggagatttggtatcatacagattccaggccattgagcctttggctgattgatttttctcgatagccaccttgtatttgggcgctaaatcttgatccggaagtggggcggcgaccaactgctttttggatttagcaggctggtaggcgcggagcacggaagcggcagacactggcgagactttatggttgccagtgtttttaatggtgtaccaaagggcaaaaatgggtttcttgccaaattcattaccagtctcaccagctggaatcacagcggttttggtaattttcagctgaaaattcttaacttgaagaaagttcttccgaaaacttgccgtgtctgaagaacttttattctgaccgctacatcctgagagggagatgacggcgattaaggtcaatgcgagtgcgaatatttttttcatgttctgagctccaatgcttatgtatttatgaaaatgatgatttattaatattttacatgtttttttcaataaagaaactcaaaatgaggaaagttgacattggataaaatgatggcagataaaaagcaacgccatgaatggacgctgctggatgatttgatgcgattatttgttgattggtttgccgaggacaatccctgggtattggtcaacggcttcttgatgatgtttgtcaaaatagaagatgccaatttgataatcctttaaggtattgcgtttggcttgattgtagcccgccttctccagtgcggccttaaccaatttcaaacgtttttgatcggaaacgtcctgtttatagaacgcccggtcaaagtatttgtcgacagatgggaacacaataacatcagtgaatgaaggaagcgacttaaccccagtagttggattggtttgaacagggaaggcatccctttcgctggttagtttccacgataatggtgtatttggaaatagttttaagaccattttagagaaatgctgtgaaggagattcctgaatgtatttggcatattcttgattatttgaaaagttgcccggctgtaggttattccacactttgtaatttgtgttatagccgggacgcagataaccacgccaaacgattcctttttgggtgtattgattatttggagtccagccattgatgccatagtagacagacaatttaccattatgcctgtacgtataagtgtgatttcgataccagttggtgttggggtaattgtttaattgaaggattttcttagtgtgcgtgctgttccaaaggtagactttacgattcttatattgggatttgacttggaaaacgtttggggaactctgccaagtcgttttgactcgttgatagccatcagcaaaagtagcaggagctgatgccatcatgcccagaccaagcgcgactgcagtggttatcatggccaaaaatgatttcaatttcataattattccccctgaatgctactgatttgaattatctaatgctcgtagttcagacataatctgcatgagcttggcatgatagatgtctgatctcaacgcgtcgttctgctggctaaaccagtactgcttggcaggggcgacgtaggtttccggcacctgatacttgtcagcaatctgctggaaagtcgttgggttgtcggctgcctgctgcaggcgatagagcggttcttcctggatgattttgacaacttgtggacggacctcttcgggcagcttgggttccacaaccttcacgaccgtattcttaattggtttatccaaaattgtattggtttgccgctgagcgtcggttaattcgtgaacctgatgaccaacgtaaagaaaaccggccaggacaatcaccaagacgcttaaccaaacaattaacttggtgtgcttagattttttctgttcttgtttggattgcttctgctgcaatcgtgatggtgtttgattttgcatgttgaatccccctcaaacaatttacgatacgattataacatttttaatcatgattcaatctgggaaggaaaccaggcatgcgaatttaaaagttccttaaaacaaaaaaatggcaagcagcttcgaccttctgaacgcatacgcgccgatcgttacttactcaccgtggtttggcaccagaaatgattatagcatggctgacttggcagatgcaagcaaatctatgaacgggggctctgatttcgacaaatgcaactgtttgctcgattgaggtataaccacagtgccagataatgtataatcgtttttgataaaattttttgacgcgggggggaaacacatgaaatcacttaaagtgcaaagcttcattctcatttcaattggatttattctagggatgagcgagtttattattgttggaatcatcaatgatctggccgattcttttgatgtgggcatttccaacgtcggcttcttggtgacgatgtttgcgattgtttacgcgattgtgacgccaattttgacgattctggtaggggagcatcgactcaagcgggtgatgttgctgttgttgagtgtcttcaccgtttcgaatgtcatgacggctctggccaactcattctttattctgtccttgtcccgagtgctgaatgcggtggttgccgggataactgtttcaattgcgattacctttgcggcggttattgcgccgcgggataaacgggcctggttgatttcttgggtcttttcggggtacagtgtcgcctcggtttttggggtaccgattgggacttggattagtgatcaggtcggctggcgttaagcattttggttaatcgtcctcatctcggtcatgattacggtcatgttcatgttgtcgctgcctggagatttgcggcaagggaaagcaaagagtttgggtgaacaattcagccttttcaaagatccccgcattctcttggggatttgtctgccaattcttaatttaggcggggtctacgttgtttatacctaccttcgaccaattgtgacatccggactgcattttccaaccagttttgtgacaccgtttctgtttgtctttggactggcatcgttgttcagtaatcaatacagcggccggttggcgaatcgggatggcttaaaatcaatggtcacggtgtttgtgattcaagctttgaccatgttggcgatttcgctgttattcgggttgccgtgggctgcactggccgccttaattatcatgggcctgacgatgtacttgctgaactcaccaatgcagattttctacctggcggtggctgaaaaagactatccgcagtcgatggtcttggcctcatccttgatttcgatttttaataacgtaggaatcgcggtaggatctgcaaccggtggggtcttgttcaatcacttaggattaaaatctctgggatacagtggggctgtgtatacggttgtggctttggcaattttaattgttttgaaccgggtacgaaagagttttgattaacgattgcaagacgacatttctcgtcttttattattttttctattgctactttgaatgaccaaatcaatgtaatcataaaaaggtcagccatgacaatgctttgtgcactgtcatggctgaccttttagtatattgatggagtcggcgggagttgaacccgcgtccgagcatattgccacctagatatctacgttcatagatatattatttgaatttcacctactgaaacgccataaatcaaggcacccacagcaggctaacctgattagtctcttcagttcacttcaggtgggagcaaactgcgtgagcccactaaatttaggacccagatctaacccatgggcgagattaggaggatctacgttaagcgcttattaggcagctaaagcgtaagaattgttattattttttgcagttataataaactgggcggtttaacgtggcgctgcacgaaacgcaatccagactcaacctatacccgtcgaatccataacgaccccgatacaatacgtatcatatcataaatcacgggaactgagaagaattgtgtcttacaacaggtcaaaatgtttgaggccgttaatgataccatgatcagtattcttggtcgtgataaactcggcatactttttcacctgtggaagcccattttccatcacgacggggtggtcaacgaaatccaacatcggaatgtcgttgttgccgtcgccaaacgcataagttgggatgccggagagattggcgttggcaatcaactcctggatgccttttttcttggaactgcctttgtgaacaatatccatgctaaacggggtatttctgaagaatgtcagggtgtcggcgaaccggtcaatgtatctttcgtcaggccccttggtgttaatcagcatcatgatcacttcttgattctcgatgaaatcatccacgcccaagtttggcatccgggagttaatgaagttataattgccgcggacgatgtcattgataaaattaatcttggcaccctggctgttcataaccgtggttgcttcgtggttggatttggcaaacgccacaaaatccttaacaacagatttttccaggacagctttgtaaaccggctggccttcgaaaataacgtaactcccgtttgcggaaaccactgtgtcgatcccagtcttttgcattgtattggggatttcaaataaatttctgccagtcgaaatcaccgggagaacctgatttgcttttaattggtgcatcgcgtcagccacttcgtcgtcaacacgcgtgtgttcattaaataaagtatggtcaaggtcaaagaacgcaattcctttatacatagataagccatccttttcattatcaattttataatcatatactttactatcataacaatattgcgactttccaagcaagttcttctaattattggtaaaatgggttatatatggggtgagacgattggaaaaaacaaccattgcgaatgaaaagaccagccgtttcttcgttcgactaagaagaattcccggcgaacattggtatttagcaaacggtaacgaaaaaaatgtaaatccaaaaaataaaattaaagttccggacagcatcaaggcacaggattttttgattgatgagattagcttcttcaacaaattagtctggtaccacttcacttgtggtgatctggaaggctggctgcccaaacgaaatattcgaaagacatttcgccgattggacgttgaaccgattaagcagcccacccaatccgatattgataatcaatgtacggcgattttaatgctgctgaacagcgccggcattagtgtcgacgtcagtgatatccgagacaaagttgagaagtggcacgcgcaatcgggaaccctaatggatttgagtgacttaattatttcgttaacccactcaattcgcgatctgaacggcgttgattttcgcaaattagataagcagcttttgcgcagaagaccgattttagtcaaagttgccggcctcgataatttaaagtccagcttgatcttgttgaccggttttaacagaaaactttactactacaacgatccgtggaccggcaaactagagtcgatttctcaaaatcatttaagaaagcattggaaacgcgggaacttggaagcaatcagttattgaaggtggggttttagaatgaaattgttgatgattgaagataacaaatcagtgtcggaaatgatgcagatgttcttccaaaaagaaggctgggatgtcacatttgcttatgacggcattgaggcaatggacaaatttaacgaagatcctgatagttgggacatgattactctggatcttaatttacctaaaaaagacggaatggaagtcgccaaagaaattcgggccaagtcacaaacagtcccgattattatgctgaccgcccgtgattcggacagtgatcaggtcttgggatttgagatgggcgcagacgattacgtcaccaaaccattttccccaattaccttggtggccagaatcaaagccttgcagcgacgggctcacactgaaactgaggaggaatctgaggacgagaaggccaaaaatgtctttgacgttcaaactgatcactttaaattgaactccagtacccgagaagtgtatttggatgacaagcggatttctgatctgactcccaaagagttcgaactgttaaagacgttggcccaaaagccacgtcaggtcttttcccgtgagcagcttttggaaacggtctggaattatgagtactatggtgatgaacgaactgttgatgcgcacgtcaaaaagttgcgtcaaaagattgagaaggttggcacccaggtgattcaaaccgtttggggcgttggctacaaatttgatgatagtgaagtgggcaagaagaaatgaaaatgatttatcagcaattattggcgttctttttggtaattggctgtacaattttattgctgggtttttcatttagccgcatgtcaaaaacgtttgtatatgaccaaacctggcataacttggaaaagtattcggatagtttgattcaacaatcgctgacgattagctccaaaaataaggccaaagtgacctttgacgaagaaaagttgaagaactctgaagccttgttggagaaccaagcggtccattttaccgtcttcagtccacaagatcaggtgatctatcccaataacggcgttgccccccgaattacccagaaagactgggagcatttgcggcgcaatcagatcgttcgcaaggtcaataataagaatttcaagctcagcaatggcaagacccggcctgcaatgattgaagttttaaagccatactattataagaaaaaactagtggccgccgtgacggttggtgcctttatttcggatgttaactccaacgtcaagcggattaaccgcgatttgttaaaggcgctgtttgtggcgttgctcatttcgatgctcattagttacttcatcgccagacggctgaatcgacggattagcaaactgcgaagtgcggccaatcaggtttcaaacggcaattacaagattcgcttgaaacccggtgggaaagatgaaattggtgaattgatcgtcgatttcaaccacatgacccaatccttgcagcaggccaacaatgaaattcagcggcaggaagaacgccgccaggaattcttggccaatgcggcacatgagatgcgaactcctctcacaacaatctcgggcattttggaaggaatcaagtacgatgtgattccccaggagtcaagggccaagagcatcgacttgatgagcagtgaaactcagcggctgattcggttggtgaatgagaatttggattacgaaaagattcgctccaactctattcagctcgataagcgtcattttaacgctgctaaggtccttgaaaatgtcatcgaccagttggacagtaaagcagaagaatcgcaggacaagctcgttttgaacgcccctaaagacctgtcaatttatgcagattatgatcggtttgtccagattgtcttcaatattgtgaccaatgcgatccagtttactgatcacggtacgattaccgtaaccggtgaacggggttacaacgagaccatcatcaaggttgccgatactggtattggcatgtccgaggatcagcaaaaaaatatttttgaacgttattataaagccgatgcctcacgaagaaccggtaagtacggtgagtcggggctgggattggcgattgttcaccagttggtgaagtcccatggcggcaagatttcggtttcatccaaattgggtgagggcacgacgtttaccgtgattattccggatgcgacagctgccgaaaaagaacaagaaaatcactaaattaaaagtcatcattttgcatttgcttgagagagtctcaaggatgcaaaatgatgactttttgttagctgtttgattcttgggctgcatgggcttcgtaagccttggtgcccttttctgttaaaccattgatttcgttgtggtcggtcacgatgtacccggctgcgaccagtggcttgggatcgccgccaatgacgttgtcacaataatcgacgaagtggttgaccggggtgccggatgatacccggccggtataaattgcctttaaaatttcatagtctgttgccgttaattccatgatgaagcctcctaatcttgatgcatttatgataccaccaggacgggtgtgggcggtgaattttgtttggtggcataagacactgacttcatcccttaaagattgggattattagcacggaccattgcgatgagcaagttgtcaccgcataaatggttaaagtgatacaatattttaaaattagtagcgttttcattaaatgtccacaactgctcaccaaaccgaagttgcgcaaatcaaaatatcaagatagtgagaaggctaattatgaaactagcaaagaaatatttatatagcaccattctcggtctctcattaggagtgggaatgtccaccaacgtggtgaaagccgccccaagttccaatagtgccgtggtttctcccacgagtgacccttcaaaagacgagcaggcaaatccagacctatcgggaaaggtcgaagatgtctcctacacggttaaggatgaccagctgactttatatggcggcacgatcaaaaaaattcacgagaacttttcacttccttggcaacaggatggggtccgtgaccgcattaaaaagcttaagattgatggcccgcttcaatttgaacaggatggtgcctatgaattttttgaggcgttggggaatcttgaaagtatatccggcttaagaaacgttgatacatcaaaaaccgaaacgctgaattatatgtttgctcaagatggcaatttaacatccattgacgtctccagctttcggacacccaatgtcatcacgatgagtggcctgttttttggtgattggaagcttgaacaagtcgatctttctaattttgatttttctcaattaaaaaatacggatcacatgtttgggggggattatgtattaacgaatatcacttttcctcattcgaaagcttctaagattgataatatgctggatatgttttacgggaatcactccttgaaaacattggacctttcagactttgacatgaccaatgtcacggctattggcagtatgttttccgaggatacgttactatcgaatctgaaactggggccaacctttaaaaattcagctttggccactctcccgccgcatcaaaaaggcgatgaaatccccattgatcccttgaaggacgccaccggtccaggatggcaagcagttggtgccaatggaacggtcaacaatccacagggcgagctctatccaacccttgaggactttgtggctaagcggcctgctgaagacgaaacctatgtctggcagcaagacaccacgcccatcaatcaatatatgctgaacctgactaatagttcggcttcagtatatgagggccttcaagctaagaattgggatccgaccagtgtgattcaattagcgactcacaatggaaccgatgataagtctgctgttacgattactgatgacaatagccagccggtcacccaggcaactattgatgcactggctcctggaacctactcgctgacttatcagaatggtgatcagaaacaaccatttaccttaacaattaaggccgatcaggccagcttgaagacgacggatattgatctttatttaaaccaggcgttcactgaagatgtgttgaaaagtaaaattttggcggtcaattccgatggccaggctcttccgtacacttacaccatcaaagatgcaactggcaaaactgtttcgcttgatgacgtcaaatcaaaggttggtcaatacacggtcgacattgttaccaatcagctgctaagtggtaacgagcccctgggagggaagctcaccatcaacgtgactgacagcagtaccctcaatctcaagtatggcaagctgacaatccccgttaatcaggtatggaaaccggcagatgcatttgataatgccaaagatgccagtggaaaagacctagcctttaaagatattttggtgacggctaaagacagctctggaaagatcatctcagacctgagtaatctgtataaaacgccaggcgtttacacaatccattacagtaatgggtcagcttcaaaggacgttcaattgacggttacccagccgacgccaacaccgtctccactgccaaccccccagcctgtgccaaatccgcaaccatcaccatcgcccaaccccatcaatccagtcacaccaacgcagccaacggttccgactcaaccaactaatccaaagcttcctgattacgcggtgacaaagggcgcggcagtcgctgccattaataatgtctatttgtatcgaacggttaacttcaccaaaggccagcgaattgccaaatatatcaagaaaccgcgcatttaccggccaatgtttgtggtgacggggtatgctcgttccacaagtgggaagatgcgttaccatgtccgtgatgtcaaccacttatcgaaaacggcgggcaagaccggctacatcaccgacaattggcgatatgtccgtccaatttattacgctactctgcacaaacacattacggtcatttctccggcaggggttaatgcctataagcacaaagacttgactggtaaggtcaaaagttatcaacagggaaccatcctcaaagttaaagggatcgtgaagcacaatctgaccacccgttatatcttgacgaatggcaggtatgtcaccgctaaccgaaagctggttaacatgggtcggcatcggaccgttaagaaggttcgtgccaagacaaccattcatcgttatcagaacgtgaacttgagcggacggcctcacactattaagaagggccagatcatcaaagtatccaattatgattactcccatggccataatctacagaagcacggtgccttgcgataccgtgtggctggtgggtatatcaccggtaactctaaatatgtcagaattattcgataatttacattagacagtgcgacgagaggcgttttgatcccagaatttaagcaaagaagcgggctattcctattttggagtggctcgctttttggggatcagtcgatcgccaagtaggccaggcagggtttcagccggccgtcgctgcacgttgtatcaatacaaaagtggtaatcaaatccaccgtagcaattaatgtcccaacctctttattttttttgcaaccagaaattgcatcagtgtgaaatttttgttgtggcattttttgttagacaatttattgaaactgtctagcggattttgcaacaaaaaaggtgttagccaaaaattggctaacaccttgctgatccttgtcaaatcaacgattatcacccgcacggggctcgaacccgtaactccgccttgagagggcgacgtcttaaaccagtttgaccagcgggcaatgctatcaaactcactataatagtgtatctaaatcagaaagatttgtcaacaaaggaaactgaaatataaagttgacaaaacgcagaaaaatctttaatatatttagttgtgatattcattgggtattcgccaaatggtaaggcaacggactctgaatccgtaatttactggttcgaccccagtatacccaatcttttgcaaggtctgttatgtttctctctaatcagagacaatgtaacagacctttttatattccataaatcccactatcatcctgtgcagaaggggatctttagccgttacccgttcatactcgtcccagattgaaattgcttacaccacagtgacccaaagtgtgctgatctagaattaaatggttaatgattcacgcatattcatgcagataggagccgatattaatggatcaatttacgttagtcaaagaaacgctggataagatgggaattccctatgagattgttgaacatcctgctgcccacaccactgaggaagccgatgagtacattaagggcaaagagggcgttcgtacagaacaatgtttatgaccaacaagaagaaaaccgagttttacctgttggtaatggacgatgccaaacgtctagactttcatgaatttcaagacttgaccaacactaaacggatcaagatggcctcagcggaatcacttaaagaacaaatggggttggagccggggatcgtctcgatttttggattgatcaacaatcacgagaagaatattcatgtttatttcgatcgggccattttagatgaaaagacaatgaccttccatcccaatgtcaacaccagaacaatttttgtcgcttccaaggacgttttaaaattcgtgaaggaaatgggctatgactaccagatccttgacttggaatcctttgattaatcagagaggttacgaatgaaataccaagatgttaccaactatgtgattgaaaaatatcatgttcaccctgaatacctgtggaaaaagtatccgagctttgccgttctgcgtcacaaggagaaccggaaatggttcggcttagtcatgcaggttgaaaagtcgcaacttggacttgatgggcagggtaaggaggacatcctggatgtcaaattggatcccaaagaagttgagtttcgacaaaccagtttggagtttctgccagcttatcatatgaacaaaaccaactggttagccattcggttgaaccaggtggatccaaagcaaattcacgacctaatcgaagctagttatcagttaactcaataaccaaaaatgaggcatccgccaaggtaaacttttccttggagggatgcctcattttattgagggtttatttaatttcatagtaatcatcggccttagattttaactgattagtctcaagcttgttgagatccagcttccgcagcgtctgtttggtcaccatggttttgacaatggttcgtttccgaccgttgccaacatttcgattgaagataatggtgaattgatcataacggtcatagtcggtctttttaattgccttcaaaataccaatcgtggttaaccgaaatgactcggtcgtatcgcttttatcggtaacggccactgtgagtgctttctggctggcatgcagcttgacttgatgatcaaatagaagcgtgtgggtggcgttcagttctttcttgacggcagtttcagtattttgagtcgactttttagccggctttttcacggccttttcggtccgctcggcctgctcggcattgccctttttgatgacttcttttcctttgggggaattaaaaaacaacgtgccaaacacagccatcagcaccaacgaaatcagtgcatacttgccgtatgggtatttaccgtgcttgccagtggtcttaaagtagacaaacatggcgaaaaaaatcaccatcgcataagacgacagcttggtaatgacatcaaacattgtgctaatcaaagtgaaggtctcctttatttggctggttattcaaatgacaggtccaccaggtatttgtgttggtccactaaatgcgaggtggtgatccacaattcatgataattggcgtctttgacctgcgtcatctcatgaaaatagtccagcaaatcactgtacattgacagaaaatctgaagacattcgattaacctcgagtttttgttcagggaaataaatctctggattccctaatttaacggtgtcatcaaggtacatttccacgacgttgtcataggtgtccggcttggtgaatactttatccggatgggccttaatgtatgataagacgtgataaattgtgtctgagttacttgccacttgaacttcctccgatcttaaaaatcctacgttcctattgtaacaaatctgagcagagtggggaaaatgttttcaagcaaccgccagtgggctcctttatccagttgtggattagcggtacaatgaatgcatctcaatgcgaaaggatgctgtccatggattatccaaacacggtcacaaaaattcatcagtttgtggacgccggaattgtccccggcgtgagttacgcgattattgatcgggatggccttcaaacaaacgtttttggtcaacaggaactgttaccggaaagattgccgcttcacagtggtgaattgtacgatctagcctccttgaccaaagtgattgggaccaccaatttaattttacgactactggcttccgggaaaatctcactagatgattccttgaccaagtattttcctcaatggcagtcgccccaggtcaccatcagacatttgctgacgcatacctcagacattgtcggctatattcctaaccgcaatcaactgcccaagtcggaactgatgccggcgttgttggccctgaaaagcggttcagatatcggcaaagttattcactatcaagactacaattttatctttttaggctggattgcttcaagggtgatgggcgagcccgttcaacagctgattagtgagtttgtgttaagaccgttggaactaaaccaagcgacattcaccccggatcaggttaacaatgtcgtcccgaccgaattaattcccagtaagggtttgatccgcggcaccgttcacgatcccaaagcgcgaatccttggtcctgactgtggttcagccggcttgtttgcgccgctcagcgatctgattcatttttcaaagtggttgttgggcgatgtcaaatatcccaactttctgccggcagactgggttgaccagctcttcgttgaccaaacgccgggacacatgaagaatcgttcgtttggctggatcctgcgtcattataatggtcatccatacattctccacacaggctacacgggcaccctgattgtggtcgatcgctattcgcataaggcgttggtctttttgtccaaccgggtccacccggatccaagcaaccagttgtttttgccatatcgcagccaactaattcgaacctttgtgaaagaaaacgagattgcatatcaataatattcagacaaaataggagtcacagcggatgctgtgactcctattgttgtattaaaatgttgcgccaactttcagattctcttgtgctgttaaatcggcgtcaggatattttcgcttcagcgcgttcatcaaaacgtgtttagcaatatcattgtttctggcaagaattggaccatggaaataggtgcagtagacgtttttgtaaattgccccttcagtcttatcttggccgttgttgccgtgaccctccagaacctttcccagtgggcgttcaccgcgacccaagaaggtaattccctgatgattttcaaagccgtgatacttttcgccggtttcttcattttcaatcacgacgttaccaataaaacggtggtccttttgtttgtcggtatagtgattcaacgcaccgatgcccatcagcttttcaccgttagcgccgatatagtagtgacccaacaattggtagccgccacaaattgcgaccacggagccgttatcttcaataaagtcggttaaagcctgctttttggtttggatatctttagaaataattgattgttcgaaatcttggccaccgccgaagacgacgatgtcatatttgtcaggatcaaatggttgatccaagctgacaacttcagacgtcagttcaacgcccattttgttggccagatacttgaggaccaaaatgttccctaagtcaccgtaagtgttcatcaaatcgccgtaaaggtgacagacgtttaaagaataggtcattaatccattcctcccttgataaagcctttggctgcaaatacttttcttaagtgtagcatagcggtgtaagttgcgaggatataaacctttttggttggtgccttggggatcatttcgacaactttgtccaaatccggttcaaccaagtgtttctttgggtcgactccggcaacttggaggcggtaggtgatatctttgtaccgctcaccgccagtaatgaactgtttgatgttcatcttgggcagtcgttcaaaatcgccatcccaaatccagctggtatcaatgccatctgcgtaattggcattgaggagcccgatgaaggtaaacgggtccttgtcagtggaaatcatgtcgatcacctgattgaggccgacggggtttttaaccagaatcagcgtcaccagcttgccgtcaacgttgatctcttcttggcggccaaagatccgttttcctttttcaaaggctttcttggtctgagcaggggagactcccatgaatcggccaactgaataagctgccagggcattgtagatgttgtaaaccccaccgatcccaattttaatcggctcaccatcgatttcaaaggtagatgatttcggggtcaagtcgttaattttgttcagcgcaaaattcaattcgggccgctcaaaaccacagttggggcagaagtacttgcccagattggaatagctgatgaaatggtagtgcaggacatgctgacattggggacagagaacgccgtccgtgttgggcgtcgccttaatgtcgccatctttttgattgtcgaagccgtagtagacgatcgggttcggcagttgttttgaatgaaaaatcggcgcgtcaccattggcgataatggtggcgttgggagctaaggcgaccccattcaaaattttattataggtcgtatagatttcgccataacgatccatttgatctcggaaaatgttggtgaaaacaaatgcttttggtttgatgtatttggtaaccatgatgacattggcttcatcgacttccagtacagccaatggccgcttgccctttgactttggtgcatgaaggaaagtggtaatgatcccttgctccatgttcgagccggtggggttggtcaaaatgttatcatacttttctttgagtacttgaaccgtcagagcggtcgtcagcgttttaccgttggtaccggtgatgacgatcacgtcgtagtcacggcccagggttgccaaaatttctggatcgagccgtttggtgattttaccgggaagcgaactgccgcccttgaaaaatgtatgcagaaaccagtaagacgacttaccggccgcagtcgcaattgaactttttaatgacataaactttactcccttaaaatgaagtacataatgaacctaatcaaacattaagtgtagcatatgctcaactgtttgaacatatatacgctcgttctttaaggggtttacaataatgagggtgctggcgaattttctcattattatcgattttcaaaactttttctgtataatggaagagaagctcttaaggaaaaaggtggatattttggctcaactattttatcggtacggtgcaatgaatagcggcaaaacaatcgaaattatcaaggttgctcataattatgaagagcaaaataaaagtgttatcattatgaccagtgcgttggacacccgagaaaagcagggcatgattgaatcgcgcatcggtttggaacgaaaagccgaaccgattcgcgaggataccaatgtctttgatttggtacaggaactaaatccccacgccagttgtatcttaattgacgaggcacaattcttaaagaaaaagcacgtcatggaactggcccggatcgtcgatgagctgaacgtgccggtgatggcatttggcttgaagaacgactttcaaaacaacttgtttgagggttccaaatacctcctgttatacgcagataagatagaagaaatgaaaaccatttgctggttctgcggcaagaaggctatcatgaacctgcgttttcacaacggcgagccggtgtatgagggtgaacaaatccaaatgggtggcaacgaatcctattatccggtctgcagaaagcactactataatccacctattaagtaacaaaagtgaggaatattaaatggacgaaattttcgacaaattacaatcggtcgttgatcgatatgatgagttaaacgagttaatcagtgatccggaagtgattgccgatactcaaaaattcatgaaactatctaaggaagaagccgaccttcgagacactgtggctgcttttaagaagtatcaaaaagtcagcaagcagctcgatgatgacaaagagatgcttcgagaaaagattgatgatgatcttgaagcgatggtcaaagatgagattaccagcctaaccgacgaaaaagacaagctcgaagaccaaatgaaggtcatgctgctgccaaaagaccccaatgatgacaaaaacatcattatggaaatccacggcgccgccggtggtgatgaaggtagcttatttgctgccgatttattcagcatgtattccaaatatgctgaacgtcagggctggaaagtggaaataattgataagaacgaaactgaagttggtggtttcaaggaaattgttttgatgattaccggcgataaggtctattcaaaactcaagtatgaaaacggtgcccaccgagttcaacgggtgccggtgaccgaatctgccggccgggtgcacacttccacggcgacagttggtgtgatgcctgaagaagaggatgttgatattgatatcgatcccaaggatatccgggtggatgtttaccgttcatctggtgccggcggtcagcatattaacaagacttcctcagctgtccgaatgacccacttgccaaccggcattgtagttgcgatgcaggatgaacgatcccagcagcagaaccgccagaaggccatgaagattttaaaggcccgggtttatgattactatgcccaacaggaacaggatcaatacaacgctgaacgtaaatcggccattggaaccggtgaccggtccgagcggatcagaacttacaattacccgcaaaatcgggtgaccgaccatcgaattggcttgactttgaacaagttagaccggatcatgaacggtgagctggacgaaattattgatgctttgattgtttctgatcaagccaagaaacttgagaatttaaccaatgaataatcaagagaacgtgacctactttgaagcccggaagtgggcttcttttcgtattaaggaatctaatgacattgacatgtacgacgtcgattttttgttagagaaactgtttaagatgtcggctgccgatctgttgattcattaccacactcagatgccagtcaagcagtggcgagtatttcaagacgcgatcggtcaattgctaaaaggggtgccgccacagtacgttgttggcgaggcagatttctacggtttatcattgaaagtcacaccagctgtgctgattccccgagttgaaaccgaggagttggttgactggatattggcagacaactcggattccaagttgaaggtcttggatattggtaccggtagtggggcgattgcgattgctctcaagcatgccagaccccactggcaggtatttgccagtgatatttctctgccggcaattaaagtggctcggcaaaatgccattgccaatcacacggcaattcattttatggtgagtgatgtttttgccgcaatcgatgagtcatttgacgtcatcgtgtcaaacccgccatacattgccaaagatgagcagtcctatatggatgccagcgtgatcaaaagcgaacctgatttggcactatacgcaaaagatcagggacttgctatttacaaacaaattgctgccgatgcggagagtcacttaacttcaaagggcaggttgtacttggaaatcgggtttcagcaacaatcggctgtgaccgagatcttccaagcagcgatgcccgacgctcaagtaattgccaaacacgatgtctccggtcatcagcgaatgattcaagtaaagaaatgaaggctatataatatggaaactttaattttaaaacagcagcaactagaccaagcggcggactttatccgtcaaggcgaactggtggcatttcccaccgaaaccgtctatgggttgggggccgacgcgaccaatgaaacggctgttaagaaagtttatgccgctaagggacgtcccagtgacaatccgctgatcgttaccgtatctgacatcgcgatggtcgaaaaatacacccaaccattttccgacgacgccaaagcattgatggccaaattctggccgggttctttgacgatgattttcaagctgaagccaaacgctttatccaaatcggttaccggcggactggacaccgcagcgttcaggttcccgaaaaaccaaaccacgctggatttgatttcaaaggccggcgtaccaattgttggtccgtcagccaatacttccggcaagccaagtccaacgactgcccagcacgtttatcatgatttaaacggcaagattgccgcaattgtcgatgatggaccgaccacggttggtgtcgaatcgacgattcttgacatgtctgtggcaaccccgtcgattttgcgcccgggtgctgtgaccaaagaggatattgaggccgttattcatcgaccggtgattgatgaactccaccatgtgggcgccaaacaaacccctaaagcccctgggatgaagtacaagcactatgcccccaatgctcaggtctacattgtcgatcctgatgatgattggcacgatgtggtcgcctggatcaagcagcacccgcagccaattggggtgatggcctttgatgacatcatcaagacgattaattggccggataatgtcgatgtgatttcacttggcaacgacgcccgcacagcagctcatgacctgtttgccgaattacgggattttgataaccaccctgcctataaaattatttttacccaaggaattgatccaaagggaattggtgaggcttacatgaatcgtttgaataaatcagctgggcaaatgcatttcaagcagttataatttatttgtaccaaataaattagtgaggtgttgcagttgaactacgattataaacagcaggatccagaactttgggatgccattgccaacgaagagaaccgtcaggagcataatatcgaactgatcgcgtctgaaaatatcgtatcaaacgctgttcgtgccgctcagggttccgtactgaccaacaagtacgctgaaggatacccgggccggagatattatggcggctgtgagtacattgatgttgttgaacaattggcgattgaccgtgccaaagaattatttggtgccgaatatgccaacgtgcagcctcactcaggttcacaagcgaaccaagaggtttatgccgcattcctaaagcccggtgatcggattttagggatgggattagacgccggcggccatttgagccacggtgccaaagtcagcttttcaggcaagctctacgactctttctcgtatggtcttgatccaaagacccaattgatcgattacgatgaagttgccagaattgcccaaatcgttcaaccaaaactgatcattgccggagcctccgcatacagtcgaatcattgactggcagaagttccgggatattgccgattctgttggcgcttatctgatggttgacatggcccacattgccggtttggttgcagttggcttgcatccaagtccagttccggttgcagacgttgtcaccacgacgactcataagacgttgcggggacctcgcggcggcttgattttggccaaagaaaagtatgccaagaagctgaactcagctgttttccctggcagccagggtggtcctttggaacacgtaattgccggaaaagcggcggccttttatgaagacttacagccggcattcaaagaatacggcgagcagatcattaaaaatgccaaagcaatggccgacgtattccagaattccaagtcagtctccgttcttaccggtggaactgacaatcatttaatgacgcttaatttaacgcagacctcattgaatggtaaagagctgcaaaacctgctggatactgttcacatcaccactaataaagagtcgattccaaatgacccattgccaccttcgaagaccagcgggttgcggttgggaacgccagccattaccacccgaggcttcaaggaagacgatgccaaagcggttgccaatttgattttacaagtgattgacaaaccaaatgatgaccaaaacttaaaggatgtcgctgccaaagttgaacaattaactgcagctcacccaattaatcaataattttgactggcttgaaactaattgtggtttcaagcctttttgtatactttccgatcgcgtatatgtgatacaattatttcggaatacaaaaaggagttggaaaataatgggtaagtttcaagttatggatcatccgttgattcaacacaagctgtcaatgattagggacaagaattgcgggactaaagagtttcgggaaatcgtcaacgaaattgccactttaatggcttttgaagtttcgcgggatatgcctttggaagatgttgatattgagacaccagaggggattgcgcatgcgaagcagatttccggtaaaaaggtcgccatcgtaccaatcttacgggcaggtatcggaatggttgatgggatgcttgatttgattccagcagccaaagttggtcatatcggtatgtatcgtgacgaaaagaccctcgaacctcacgaatattttgtaaagctgccatcagacattggccagcggcagatttttgtcgttgatccaatgcttgcaactggtggttcatcaatcatggcgattgatgccttgaagaagcgcggcgcatccaacatcaagttcgtttgcttagtagctgctccggaaggggtcaaagcacttcaaaaggctcatcctgatgtggatatctatactgctgcacttgatgaaaaattaaatgataagggctacattgttcctggactcggtgacgctggtgaccgtttgtttggaaccaaataattgattgaagctgagacaaaatgaaaattttgtcgtcagctttttattttatttacaaaaggattctggctttgatagccaacgaattaagtctaatcaaagacccttgggtgacattcgttgtgcatgccgttgaacactactgctcacgcgaagtttccctgtcaagattgttttgaattttgtaataaatggtggtatgatttcaattgtatttgaacacgggtctgtgttcagtaccatcgcaatgtttcactttggtattactgtcttctggaccaaaaccagattgatttgcatgcgtgattatgtggaggaaagaggtgagattttgtgggagaagctgcttctacttttgaattcttaggactgacgtttaacgttggtaatttaatttcgatattactggctgcttgtgtggtttttgttctggtgtatgctttatcaaggcacttgacaatcaaaccgggcaaggcacaaaacgttttagaatatgcggtggactttaccaatggtattgtccgaagctcgatttccggtgaaacaagtagaacactaggtttatggggctttactctgtttatgttcatcattattgcgaatttgcagggactcttcttgcatatcgacatttctggtgtaacatatgtcaaaagtccaacttctgatccggttgttactatgactctggctctgatgactctaacgcttgcacaattccttggaattcggcagttaggttacaagggacattttcagaattatttaaagccattcgtatttttcctgccaattaacttattcgaagagtttactaatttcttaacgttgggattgcgactatttgggaacatcctttcaggtgaaatgcttcttggaataatccttggcatgtcgcatggtggagcagttatgtgggtcgtttcattcattcttgaattggcctggacaggtttctcagtctttatcggatgtatccaagcctatgtttttgtgacattatcatccgtatacatttcacgaaagctcgagcttgaagattagcaaaaatatttttggagactataaggaggatttttaattatgggagcaattgctgcaggtattgcaatggccggtgccgctatcggtggagctgttggtgatggtattttaatttctaagatgttggaaggaatggcacgtcagccagaattatccggacaactgcgtagtaacatgttcatcggtgttggtttggttgaagctatgcctatcatcgccttcgttgttgctttgctggttatgaacaagtaataaccggtttagtcaaatacacaaagaaggaggtgccaattgatgttttcatattcagtagttggagctcagctttatgttggtgatatgctgtttgtcatgatcacatttcttgttttaatgtggttggtcaagatcgttgcatggaagccaattacgaagatgatgcaagaccgttcagacaagattgttaatgatattgattctgccaaggaatcacggactaaagcagctgaacttgctcaaaaacgtcaggctgaattagacaaaacgcgtgatgacgcaaataccattattaacactgccaaacagaatggacaaagacaacaagaacagattgttgaagatgctagaaatgaagcatcgaatcttaagagttctgctgaaaaggacattgaacaagagcgacaagaagctttggctaattctcgaaaagatgtggcaagtctttctgttgaaattgcatccaagattatttcaaaagaattaaacgaagatgatcaaaaaggacttgttgactcttatattgaagggttgggtaagcagaaatgacattagatgatatgagcgcttcaaaaaaatacgcaaaagccatgtttgaagttctgagtgattctaatgaacttgaatctggttacgctgatttgcttgaattacgtaaaatttttgctgctaatccaaggttgattgaaattctcgatgatattcgagtttcagatgacgagaaaaagtctctgctggctcctatcacccaaaatgcatcagactttattaataactttttaaaggttgttgccagctatcgccgtttcccacaggttctgagcattattgatcagttccaaaaggtttacgaagatgacaagaagattgtccgggcgcaagttgtttcggcaacgccgcttgatgacgatcagcttgatcgtttggcaaaagcgtttgagaagcgggtaggtgcggttaaagccatttttgataccaaagttgataaatcactcatcggcgggatcgtgattcgatcatccgatgtgattatcgatggaagtgttcaaactcgcattaataaagttaaagaattattgttgaattaacgatatctatttaaagaggtgaaacttatgagcattaaagctgaggaaatcagtgctcttattaagcaacaattacaaggctataagaacgagctcgacgttcaagaaacaggtatcgttacatatgttggtgatggtattgctcgtgctcatgggctcgaaaatgcgttgtctggagagttgctcgacttcggccacggcgtttatggaatggtacaaaacctggaaaccaatgatgttggtatcatgattttaggtgatgacacgaatatccgtgaaggtgattctgtaaagagaaccggccgaattatggaagttcctgttggggacgagatgattggacgagttgttaattcactcggtgaaccaatcgatggtaaaggtccaattaaggccgacgatcacaaagcgattgaacataaggccccaggtgttatggaccgtcaatctgttttcgaaccattacaaactggtattaaagcgatcgattcattgattccaattggtagaggtcagcgtgagttgatcattggagaccgtaaaactggtaagacttcaattgccattgatacgattttgaaccaaaagggtcagaatatgaaatgtatttacgttgcaattggacagaaacaatcaactgttcgaactgccgtaagtacccttgaaaagtacggtgccatggattacacaactgttatttcagctgggccatccgaacctgcatcattgctttacattgcaccttatgccggcgcaacgatgggtgagtacttcatgcacaagggtcaacacgttttgattatctacgatgatttatcaaagcaggctgatgcttatcgtgagctgtcacttattcttcgtcgtcctccaggtcgtgaagcttatcctggtgatattttctatacccattcacgtttgttggaacgggctgctaagttaagtgacaagttgggtggcggttcaatgaccgcgatgccaattgttgagactcaagcaggggacgtttcagcttatatcccaactaacgttatttccattaccgatggacagatcttcttggatgccgatagtttctattctggtgttcgtccagccgttgacgctggtacttctgtttctcgtgttggtggtgatgcgcaggttaaggcaatgaagaaagtttccggtactttgcgtcttgatttggcttcatatcatgaattggaatcatttgcacaatttggttcagatcttgatgaagcaactcaaagcaaattaaatcgtggtgcccgaacggttgaagttttgaagcaaccacttcattcgccaatttccgttgaaaaacaggttgtcattctttactgcttaacccatggattcttggataaaattgcaattgatgatattttgagatatcaaaccgagatcttcgattacttcgatcaaaatcacaaagatttgttggaagatatcgctaagaccggtcaattgcctgatacaagtaaaatggatgctgcaattaaagactttgaacaaactttccaaccaagcaagcacgatgatcaacaatcaaacgatgatcaatcagctgcttcaaatgactagttttaaggagggtgagattacatgggtgcttcgctaaacgatgttaaacatcggattacttctactaagaagacgcgacaaattaccaatgccatggaaatggtttctcaggcaaaactgaaccagatccaaaagcatacggttagttatgcggaatatgcaagccaaatcaaatctgttgtattgcatttagcccaatctcacattttagatgggctaaacaaatcctcaggtcattcagctgatcaagatcaatctaagactaagagaagcgcatatttaattatcacctctgatcgtgggatggttggtagttataatagtaacgttatccgtgaagccaatgagtttattgagaagcattcgggatcgaatgattatcaaattctcgctgttggtggaaccggatccgacttttataagaaacgcggcgacaatgtttcttatgaataccggggcgttagcgatgtgccaacctttaacgaagttcgtcaaatcgtcaagatggtgacatcaatgtacgataaaggtcaattcgatgaattgtacgtttgttacgagcatttcgttaaccgtcttatttcccgtttcagagctgagaagatgctgccaatcgatgatgaagccattgcgtcagctgccagccaggacattgaagttaagccgatgagtgctgaatacgatgttgagccttctgaaaaagaagtcttggatgttgtattaccacagtattctgaaagcttggtttatggggcaatccttgatgccaagacttcagaacatgcttcaagttcgactgcaatgaagtcggcatctgataatgctgacgatttgatttcctcattggaattgcagtataaccgtgctcgacaggctgccattaccactgaaattactgaaattactggtggtcaagaggctcttagtcactagaaagatttgaatggaggaattaactaacatgagttctactggtaaagttatacaagttattggaccagttgttgatgttgaattctccttggacgataaattaccagaaattaacactgctttagcaattcacgtcagcgaagacaagaatttgattgtcgaagttgcccttgatttgggtgatggcgttgttcggacaattgctatggatggaaccgatggtcttcgtcgcggtatggacgttgaaaacaccgaatcttcaatcagtgttccggttggtaaagatactcttggtcgagtattcaatgttcttggagatccaatcgatggcggcccagaatttggccctgacgctgagcgttggccaattcaccgcgatgctcctaagtatgatcaattaaacccatcaactgaaatccttgaaacagggattaaggtgattgatttattggaaccatacactcgtggtggtaaagttggattgttcggtggtgccggagttggtaaaaccgttttgatccaggagttaattcacaacattgcacagggacacaatggtatttctgtgtttactggtgttggtgaacggactcgtgaaggtaacgatatgtactacgaaatgaaagggtcaggggttctcgagaagacggccatggtttatggtcagatgaacgagcctcctggtgcacgtatgcgtgttgccctgactggtttgacaattgcggaatacttccgtgatgaagaaggccaagatgttctgttgttcattgataatatcttccgattcactcaggctggttctgaagtttccgccttgctcggccgtattccatcagccgttggttatcagccaacgttggctactgaaatgggtcaactgcaggaacgaattacttcaaccaagaagggtgccattacatcaatccaggccgtttatgtgcctgccgatgattataccgaccctgctcctgcaacgacatttgcccatttggatgccacaaccaacttggaacgttcattgactcaacaaggtatttaccctgccgttgatcctttagcttcaacatcatcagctttggatccagcaattgttggtcaagaacattacgaagttgccactgaagtccaacatgttttgcaacgatatcgtgaactgcaggatattatttcaattcttggtatggatgaattgtcagacgaagagaagacggttgttaaccgtgctcgtcggatccaattcttcttatctcaaagtttctcagttgctgaacagtttaccggcttacctggtaaatacgtatcagttcaggatactgttaaaggctttaaggaaatccttgaaggtaaatacgatgatattccagaagatgccttccgtaactgtggccctatcgaagatgttgttgaaaaagccaaggctatgaaacaggaatcagacaacgaaaagcagcgtgctgcaaactaaggagggattctaattggctgataattcagttattaccgttagtatcgttactcccgatggaaaagtttacgagcatactgctagtatgatagttgtttcaactcagtcgggacaactaggaattatggctaatcacgttccgattattgcaacacttgacgttgatgaaacgcgagttaaatacgacgacaaggaagacgatattgctgtcaacggtggctttatcgaattctcaaacaacgttgcgacaattgtggctgatagtgccgaaactcaaaatgatattgatattgcccgtgctgaaaaagcaaagaagaacgcgcaacaaagaattgccgaagcccgtcaacgacaggataaggccgctcttgatcgtgctcaagttgctcttcgccgtgcaattaaccgaatcaacgttgccgggaaataaccgttatttctgattgcggtttccggaaactgaatatggtacttcaaaagctgcgcccatttgggtagcagcttttttggttagtcggagttaatccttgaaattaccggtgaatcaggttagaattcctttatcgtgatttgtgaatgatgtatttatgtttgcgtttttctccagtttggtcggaatcatatacagtcattgttatccgaatgtgccgattagatagcaattctgcttatatttttgtaaaagaaaccgaaaaggtaagacaagttcgcgtctttatgatatagttgtctgtgaattgggggaagactcaaatgaatacgattggcattcaagcgctgattacattgattacatacattttgtttatcgctatggcgttttggacagttcaagaaatccacatcgagcgttatatcccattgagggcaatgccggggaaattactgatcgtgctcgtttcaattgcgattgggtacgcatgcagttcatttttcctctctgtaatatttaacattcagaatttgatgtatctaattaagtgatgtaggaggcgttcttgtggaaaaaattattgtacatggtggtaagccacttcgagggaaagtacatattgatggggccaagaatgccgttttaccaatccaagctgcaactattttagccggtgagggaaagacggttatctcaaatgtgccattgttgtctgatgtgtataccatgaataaagtgttgcggttcttaaatgtgaaggttgattttgatgaagccaataacgaaattacgtttgatgcttcaaaagatatctccagtgaagcaccttttgagtatgtctcaaagatgcgtgcctcaattgttgtcatggggccgcttttggctcgactcgggcacgcaaaggttgctttacccggtgggtgcgcaattgggtcacgaccgattgatctgcatttaaaaggatttgaagctttaggtgctcggatcgaacagcatgacggctacgttgaagcttacgccccggatggccttaccggcgctgaaatctatctggattttccaagcgttggtgccactcaaaacattatgatggctgcaacattagctaagggcaaaacagtcattcagaatgctgcccgcgagccggaaattgttgatttggctaacgttttaaacaagatgggggccaaagttgtcggcgccggaaccgaacagattcgcgtggaaggggttcctgaacttcatgggaccgatcacgcggtggttcaagatcgaattgaagccggaacattcatgatcgctgctgcggttacccgtggtaacgtgatgattgatggtgctattcccgagcataacaaaccactgattctcaaaatgcgcgagatgggcgttaccatcaacgaaagcgatgatggcattcaagtcatcggccacgataatctcaaaccggttgacgttaagacaatgccgcatcccggctttccaaccgacatgcaaccgcaaatgaccattttacagttgacggccaatggcagcagctcaatgactgaaaccgttttcgaaaatcgtttcatgcacatggaagagctgcgccggatgaatgctcaatatacgatctccggtcgaacagtcatcatggatggcccaactgattttaatggcgccgaagttgcggccaccgatctgcgggccgccgcatccttggtgattgccggcttggccgctagtggctataccaccgttaccaacttacagtacctggatcgtggttaccacgatttccacaagaagctcgctaatttaggtgctgaaattaaaagagtcaacgttgaagacgactcaatcgtcttgaatcaatcgctcaagaatcgttcataatttttcggggttgggatcgttacttgatctcaaccctttattgtttggagacttattagaaacgcaaactttatgtggtataattattttttgagattaaagtttttcaggaggaacctacacagatggcaaaagacattggaattgatttaggaactgccaacgtactcatttacgttgccgggaagggaattgtattgaacgaaccatcagttgtcgcagtcgatactcggactggtaaagtcttggcagttggctccgaagcctatcggatggttggtcggacgccaagtaacattcgtgcgatccgcccattaaaagacggcgttatttctgattttgatattactgaagaaatgctgacatatttcattaacaaattggatgttaaaggatttatgtccaaaccaaaaattatgatctgtgcaccaaccaacgtgacggaaattgagcggaatgcgatcatgcaggctgctgaaaaggctggtggcggacaagtctatctggaagaagaacccaaggtggccgctgttggtgctggaatggatatcttccagcctcgtggtaacatggtcatcgatatgggtggtggaaccagtgatatcgccatcatttcactgggcgatattgttgccagcaaatccattcgagttgccggtgataagatgaacaccgagattgccagctatatcaagcaaaagcataacctgattattggtgagcatactgctgaaaagattaagattgaaattggaaccgctaagaaagacgattcagatgttaaaacgttggaagttcgtggtcgggatgccgtttccgggatgcctcgggcggttacgattgatagcaatgagatcgctgaagcaatcaacgataccgttcaattaatcatcagtggtgccaaagaagttctcgaagtgattccacccgaattggcgtctgacatcgttgaccgtggaatcatgctgaccggtggtggtgccttattaagaaacatcgatcaagtaattgccgatgcgctaacagttcccgtgattatttccgaaaatcctttggacaatgttgccaagggtgccgggatccttttggagcactatattaagaaccctaagttgaaggcaaaagatcaaaaataacaggagtcaaagtgaaaaacattctgattagtcttgttcatggttatcagcgctttatttcgcccttattcccgcctacctgccgttattatccaacttgcagcagttatatggtaactgcccttaaaaagcatggtgcgttcaagggggccgttatgggcattgcccgaattctgcgttgccatccgtttgttaagggcggctatgatccggttccggatcactttaccatttttcggaataaggacgcacgcgatgaataccggaaatccatgcacctgaaatgatctttgaacaaggagaatatgatgagtaaagcaaataaaagtatcaacgttgaaattaaagatcgaacggatcaaaatggagaatcgatctccgaattatttatcggcaagaaattgattggctcaattaagcagttgagcgaaactaaatttcaagcagtcaacactcacgacgaagcgtttcatgttaaaaccttcgatgagggtgtgacacaattaatcaaagattttcatcttcaccattaatttggcgatcgaaaacgaggagggtctaatttggatagcagtcgcagaacctctaaagacgaccaatcgcgaattgactggggaattattttctgtgtcttaatgctggcgttgattgggctggcatcgatttacgttgcagccacccatgattcaagttctaccagcgtcatgagacaggtggtttcgcaattggtttggtacgtcatcggaattatcgccgttgtcattattatgcagtttgattccgagcagttatggaaagttgccccgattacttactggctggggattgccctgctggcgagtgtcttggtgttatacagtcggacctattacattaatacgggtgccaaaagttggttctccctatttgggttgacctttcaaccgtctgaagtgatgaaaccggcctatattttgatgatggggcgggtgattgttcaacataacgataattacccaatcaggactgttcgaagtgatttcctattaattgggaaaatgttgctgtggacagttccggtagccgtcttgttaaagctgcaaaatgattttggaacgatgttggttttcttcgccatcttaggtggcttgatcatcgtttcaggagtgacatggcggattattctgccagcggtgattaccatctttggatttgccggaaccatcttggctttggttattccggagtccgggcgtcatctgttggagaagtttggttttcaagcctaccagtttgcccgagttgacacttggctcaacccgtcagccgatacttccaatcaggggtatcagctgtggcagagtatgaaggccatcggatctggtgggatttttggaaccggatttaatcagtcacatgtgtatgtgccggtgcgagaatctgatatgattttctcggttattggcgagaactttggatttattggcagctgtattttgattttattgtatttcctgttgatttatcaaatgattaaggttacattcgatacgaggaatgttttttacgcttacatttccactggcgtgattatgatgattctgtttcatgtttttgaaaatgtcgggatgagtattggcctgttgccattgaccggtattccattgcccttcgttagtgccgggggatcggcgttgattgggaacatgattgggattggcttaattatgtcaatgcagtatcataataagagttacatgtttggagaagacaaagaattctcataatttttagaaaaggtggaattaatgatggatacaaaatattattggactgaagaaaataacggggaagtcacagttggcttgaccgaagcaggcaagaacgaactgggtaacatcacctttgtttcccttccaaaggttggtgctcaattaaccaccagcgatactttattaaacgttgaagctgacaaagccgtttcggatattccaagtccagttgctgggaaagtgactgctgtcaacagtaatgccgttaatgacccttcagtattaaacgggactgacaaggcaacttcatggattgctaagattcaaaaataaaagttcttgacgctaggactttttttaggtacactaactgatagtttgatgatagaaaaattacaagatgagtagataattagagattgtcaagagagcccggctggtgggaaagggtcaatcatcgttattgaagatggtcttggttaaaaatgtgtcggtgagcaattgcaagccgataatgggtaacgaccattatttcgttgagtatgaagatactcatgaggcgattgttgaaagacaatcgcgaataaaggtggtaccgcgaagtttttcgtcctttcataagtcaattaagacttatggaggatgaaaagctttttttgtctaataaggggtgaaaagattgattcgatttaaagatgtatccaaacagtacagtaccaaggatggcggtctaaccgcggtcaatgatgtcaacattgagattaacgatggtgagatcttcgggattgtcggctattcaggcgccgggaaaagtaccttggtgagaatgctggacggacttgaagcaccatcgaccggtgaaattgacattaacggaacggatgtttccaagctccacggcagccaattaagaaagcaacgtcaaaaaattggcatgatctttcagcatttcaacttattgtggtcacgaacggtgctggacaacattgctttaccgcttgagattgccaaagttcccaaagccaaacgaaagcaacgcgcagaggaattgatcaagttggttggtttggagggccgtgagcattcctatccttccgagttatccggtggtcaaaagcaacgggttggcatcgcaagagccttggcgaacgagccgacaatcttaatttcagacgaggcaaccagtgccttggatcctgacacaactaatgaagtccttgacttattactgaagattaataaagaaatgaacctcacaattttattaatcacccatgagatgcacgccatcgccaaggtttgtgaacgggtggcagttatggacagcggcaaagttgttgaaaccggatcagtgtttgaggtcttccgtcatccacaacaagaaatcactaaaaaatttgtcagtgaagaatttacaccacaacaaagtgacaacacgatgacccttgatgaattggttaagaaatatcctgatgggcaaatcatccgactgattttccatggaccacaggcggaactgccaattgtctcggatgttgtcaaacggttcccggaattaaccatcagcattatttccggtgccatccatcaaactcaagaaggcgcgttggggtcgctggatctgcaatttgtcggcgatgacaatcaaattaacgatgccttggaatacctgaaaaagatgcgggttggaacggaggtgattcatcatggctaattcaactggattcaaatcttacttccagtttcataacgtcgattggggttcgatgatgtcggcaacttgggaaaccgtttggatgaccctgttatcaatggttgcaattgttattttaggaattattttggggctgatcttatacgagactcgcaacaagccgggcattggctatcgaattctcaattggctggtcggcttgttcgttaacatcttccggtcaattccatttatcatcctgatcattttgttactgccaattaccatgaaattggctggaacgatcattgggccgcgggccgcgttaccatccttgattatttcggcggcacctttttacgctcggatggttgagtcctactttcgtgaggttgattccggggtcttggaagctgccgaatctatgggtgccacaacctgggaaattatcaccaaggtcctgttaccagaaagcaagccggcattgatcgccggagctactgttaccaccatttcgttgattggctacaccgctatggcaggtgccattggtgccggtggccttggaaacttagcttatcaagatggtttccaggcaagcaacaacacagtgaccttagtcgcaacggtcatcatttgtttatttgtatttgtcgtccaatttgtcggcgatgtctttgtcaagattaccgacaaacggacattataatatttgggagggtttcaaatgaagaagaaattattgagtttattcgcagttgtctttaccgcctttttgttggtggggtgttcatcatcgtctaattccagcaaaaagacgaccacattaaaaattggtgcttcagccgtgccccatgcacaaattttgcgccacgtggctccagaacttaaaaaagaaggcgtcaatctgaagattaccactttccaagattacacgatgcctaacaaggctttggccaacggcgaactggatgccaattacttccagcatgtgcctttcctaaagctttggaacaagcagaaccacggaacattagtcaatgccggtggtgttcacttggaaccgatcgctgttttctcgaagaaagttaagaagcttcaagatctcaagaagggtgccacaatcattgtcagcagcaatgttcccgattatggccgaatccttcagatcttcaaagacgccggtttaattacactgaaaaagggcattgacattacttctgccaacttcagtgacattgcttcaaacccacgtcatctgaaattcaagcacagctatgaaccaaaattactgccaaccatttataagaatggtgaaggagatgcagttgtcatcaacgccaactacgctgttggtgccggcttgaatccaattaagcagtcaattgcgattgaaaaacggaattcaccatacgtgaacatcatcgccacccgtaaaggtgatcagaacaagccagccatcaagaaattagtcaaggttcttcaatcaaccaagactcaaaaatggatcttgcatcactataaaggtgccgttttacctgagaagaatgttaagtaattaatatcaattaaaagccgtccgctatatacttgaattagtaattgtttactgtcgattcttgtggcaagctcggccgcaagaactcgcactattccgcctagtaatgatgattttcgttccgaaaatctttcttgctccagtcgatgttgattcttgtggcaaactcggccgcaagaactcgcactacgttcccagcccaaatttgctggaagacggcattttatctaattttgctgtcatgaacggtttcgtatcaagcaacaagataagttttgtagtttcaccttgagatttttaaatattgattgatgcagaactggaagtgaaatgacttctggttctttttttgattggaactggcggataaaatttcacgcgttagtttagttgtgcggtatgataagggtggcagtaagttagcaacgaaacattttgaaactggacaaaaaaagtacattatgagaacaaattctggtattcttatacgtagatcgttttgatgtgttaatttatattaacatcacacgttgaaagtaatgaacggggatagctgtgaataaaaaaatttataccacaaggctaaagctgcgaccatttgtgccggctgatttaacaggattgcgtgccatcgttgaaaacaaagaaattgcggagatggctagttttcgcgtggctacaaatgcgtttgaaagtgattattttttacagcaacttatgcaacccaacatttgggctatgacattaaagcaaacttcagaagttatcggtagcattggactttatccagtggtaggtgacaatcatgaacgggatcctttaaaactggaattaggttacatggtgaatcaagatttttggggttacggctatatgacagaagccgttcaatcaattttaaatcatacttttcatgaaaactccgcatatgtcgtattggcaagtacctatgctgaaaataaacgatcggcagctattttagaacatcttagttttaagaaggtcggtgaacatgttttaccggcaagtgtgttaaatccggtttcgcgacgagaaaatttttatcaattaacagcgcaagcatttatagaaggtggtcattatgcaactcactaaaggatttgaacaagcagcatgtattattgcgttattgtgtacacaggatagctcaattccgttgacgacggcggtgattcacgatcgattaacaggatcagagacttatttgcgaaaaattatgcgtaaattggttgttgccggtttggttacctcaattccgggaaataatggcggttttcgactggccaaaaagccaagtgaaatttcattactggacattgttgaagcgagtgaaggacccattaaaacatatccagacatgggttttattgaaaatgtgttttctgaggcccatccgattgccgaacggggtaagaatgtattaaacgatacatttcaacaggcggatgatttgtggcgcgactatcttaaacatcaaagtttgaatgatgtgctcgttaaaattatgggtgaacctgcagttccgggaattgattggaacggttctgacaatgagttacatgcccagtttcaaaagttaaacgaaaaaatttagggcacaaaattaacgaatgattaacacttggtgttgtcagatacactgagcttgtatataattgattcatatcgaaagaagaggttgccaaactcatcagtcacagcttgtagatgaaaaagcattgtagacaagctgcaaaagggtgtttggccgaaattttaagttgctttttcaacttagagttgggctctggtttaataaatcagggactgtcgtgatgcattcaaacacatcacggggcgctatctacgatttgactgagaaatttagtaagtctttttgtatggcgatttgttatgcaaaaaggctttttttattggttaaaaataagattgcctttttaattcgaattttaaggaggaagtagttttatggcagaggaagagaatcattcaattgatcgatctttgaagacacggcatatctccatgatcgcacttggaggaagtataggaactggattatttgtggccagtgggtcagcaatttcagaggctggtccggctggtgcactgattgcgtacgtggcaatgggaatcatggtgtatttcttgatgacgagtttgggggaaatggccacttacatgccagtttctggttcgtttgcaacctattcaacaaagtatgtggatccagctttaggatttgcgatgggttggaattactggtttaactgggcaattaccttagctgttgatatcagtacagtttccattgttatgaaattttggttacccaacgtacctggctgggtttggagtacagtggcgctgatcttaatttttgcaattaatgctttaacggtaaaatcgtttggcgagactgagtactggatggcgttgattaaggttgtcacggtaattattttcttagttattggtgtcgctgtaatttttggcatcatgggtggtcatgccacttatctaaataactttacctataagaaagcaccatttgtcggcggaattccaatgattctgagcgtttttgtagttgcgggattttcatttcagggaactgaattgattgggattacagctggggagtccgaaactcctgaaaagagtgttcccaaggcaattaatcaagttttttggcgaattttgttattctatattttagctatttttgtcatcgcttgtatcatcccatacactagtcctgatttattaggttcttctgcaagtgatgtcaaaattagtccgtttactttagtgttccgtcgggctgggttggctggggcagctagcattatgaatgccgtgattttgacgtcggtgatttcatcggctaattctggtatgtatgcttcaacccgaatgctttattcgttggcattacaaggatacgcccccaagacatttagtttgactactaaacgaggaattcctttgatggcgttgattggcacaacgatcgtgggagctttaacatttatttctagtattgcgggtcctgaaatctatatgtggctggtcgctgcaagtgggctgactggttttattgcttggttagggattgctatttctcatttccgttttcgcagggcattcgtcaaacaaggacacaaagtcgaagaattacgctaccatgcaaaatggttcccatttgggccgatttttgcgtttgtactgtgtctactcgttattgccggtcaagatatccattcgtttgccacgtttaactgggaagcaattgggatcagttacatgagtgtcccgatttttatcattttatatacgtattataaaattaaatatcatactcatgttatttcgttggacgaagttgatttaacacaacctgattttattttaaaggctcgaaaagctgaaaaataagtgtataatgtaaggcgctgcaataaaacagactgtttttgagaaaagaagttttaatctacatgttgttttagcttagattcatgctacaatatatagtattaaaacaggaataaaggggaacttcgaatgattgcattgtcaggcccaatcggcgcaggaaaaacaacgttaacagaaattttgtcacaacatttaggtacaaaagcattttatgaatcggtggatgataataagattttgccactcttttataaagatcctaaacgctatgcttttcttcttcagatttattttctgaatcgccgtttagatggtattaaagaagcttttcaaaccaaaaatagtgtgatggatcgttctatttatgaagattcacttctattccatctgaatgcagatttgggtcgggcaacaagcaccgaagttcagatctatgactctttactaacaaatatgatggaagaacttccagaaactcattatcaaaagaatcctgatttgttaattgatatcaacatttcgtttgatacaatgttggaacggatcaaaaatcgtggtcgctcatatgaacagattgataatgatcctagtttatatgagtattatcgtgacttgaatgatcgttatagtgagtggtatgacaattataatgagagtccaaagattcaaattgatggggatcagtttgattttgtggaagatccacaggcacgtcaaaaagtaattcaaacaattgatcaaaaaattgctgaaatttagttgtctattggattagtttcggttatgattaggttattaataaataaacgtagattcacataaagtagatttaaagcgagatagagttagtgaaagctatcaatcgaaactccggtggattaaaacgggtgagtaatttcacacggctgcggtcgttaaactccaattaagggtgctggtaacagcaaacttgggtggtaccgcgaaaaagaccttttcgtcccaattaatgggatgattaggtctttttattatgtatacaaaattgaaggaggacatgaaaatgttagatttaaaaaatattcgcacaaatacagatttcgtaaaagaacgtttagggacacgcggtattgatccaaaagaaattgaaaaattattggacgtggatcaaaaacgtcgggacttaatcgtcgaaagtgaaacactcaaaaagacgcgtaacgaggtttcagaccaaatttcgttattgaaacgtcaaaaagaagatgccaatgacaaaattactgaaatgcgcaaagtaagtggcgagatcaaggaacttgatgcccaattgcaaacattgactgaacaagttcaggatatggcagctcatttaccaaacattcctaaccaagatgtcccaatcagtttgaccgaagaaggcagtgtggaattacgcaaagtgggtaaacctcgtaaattcacgtttaaaccaaaagcacattgggacattggtgaagatttaggcattttagattttgaaagagcagccaaggtatcaggcagtcggtttgtttattatattggcatgggtgctaagctggaacgggcggtttataactttttcttagatcaaaatgataaagctggttatacggaaatgattacgccctacatggtgaatgatgagtcaatgtatggaacaggccaattccctaagtttaaggaaaatcatgccggctatgagattcaagatagtgaattaactttaattccaactgctgaagtaccattggttaacttccatcgcaatgaaattttggatggggatgatttaccaattaatgaaacagctttatcacctgcatttcgttctgaagcggggagtgctggccgtgatacgcgtgggttgattcggatgcatcaattcaacaaggtggaaatggttaagtttacaaaacctgaaaattcatggaacgaacttgaaaagttgactaatcaggcagaaagtttactgaaattattgaaattgccataccatgtgattaccttaacaacgagtgatatgagttttactgctgcgatgacgcatgacttggaagtttggattccagctcaaaacatgtatcgtgagatttcgagttgttcaaattgtacagattttcaggctcgtcgggctcaaattcgttatcgagatgaaaatggcaaattacaatatgtgcacactttgaatggttctggattagcagttgggcgaacagtggctgctattcttgaaaattatcaaaacgaagatggatcagttaccatccccgacgttttagtaccctatatgggtggtgtgacaaaaattacaaagtagctgtgaactgggtgatactaggaaaggatcaaatataattcatagtggatattttacgacaactacaaaaatttattgacaattggtaggggtcaatgataatattatgtagttgtcgtttgatggaggattagctcagttgggagagcgtctgccttacaagcagagggtcacaggttcgagccctgtatcctccatttgagccgttagctcagttggtagagcatctgacttttaatcagagggtcggcagttcgaggctgccacggctcatttacaaatataagcattgcgggcgtggcggaattggcagacgcgcaagatttaggttcttgtatcgaaagatgtaagggttcgagtcccttcgcccgcacttctaattaatattctgtattaattagccgacttagctcagttggcagagcatctgttttgtaaacaggaggtcggaggttcgaatcctctagtcggcattagcaactatgcggaagtagttcagtggtagaacatcaccttgccatggtgggggtcgcgagttcgaatctcgtcttccgctttgtagttttcactacaagcacacatatattgccggggtggcggaattggcagacgcacaggacttaaaatcctgcggtcagtgatgaccgtaccggttcgatcccggtcctcggcattttatgcacccatagcgcaattggatagagtgtctgactacgaatcagaaggttgtaggttcgactcctactgggtgcatccccttcaggattaactgtttattgacagattgactgaaaaaaacataaaatgccaactgtaattcgtttactagttggcattttacgtttaggagtattttagcaacaatgtgtggatttaagaacaaacgggaagtagctcagcttggtagagcacctggtttgggaccagggggtcgcaggttcgaatcctgtcttcccgattacgcacttagacggtggaaaagtgcatttacggagaattacccacttaaagttatttaccaataacgggaagtagctcagcttggtagagcaccacgttcgggacgtgggggtcgcaggttcgaatcctgttttcccgatttatgaagagaagcatcaaatcagccgatttgatgcttctctttttataaaatgctacattacaatagtacaaagtttacaatagtacaaagtttaatcaaaaaattaaaaggtccatttcaaaaatgattgaatatctctaaattgttcacctgatgaccactatttttaagttttaatcatcaagtgtcggcctcagtacaaaaaactttgctttttatgaagagtttcgtataatgaaagtcaacattagtcaaagatgcaagaaagggtgtgcgaaatgcaaggtcagaatatttccgatatcattgaaaaatatttaaaacagattttagcggactcggaagaaattgagattcgacgctcggaaattgctgatttgtttgatgttgtgccgtctcaaataaattacgttattaaaacccgcttcaccattcaaaatggctatgtcgtggaaagtaaacggggtggcggtggctatattcgcattgaaaaagtcaaattacttgatgatttggatgttttggatacacttattcaagtgattggtgaatccatcaatcaacgtgatgccctttccattgtcaaaagtttgtatgaagacgacgtcattaacaaacgagaaggaaacctgattttagcagcaattgataagaagacactagcgattaacgatcgggatatggaaaatcagttgcgagcaagaattttaatcggcattttaaatcacttaaggtatgagagttaaaagaaagtagggtgttagcatggataacttatttacaccaagtgccaaaaacgtgctggctatttcacaagaacaagctaaacgttttaagcaccaagcagttggaacagaacatttactgttggccctagcaatcgaaaagaatggtattgcctataaagtttttcaacaattttcagtaactgaaactgatattgtagaagaaattgaacgttttactggttatggcactttgaaaaatgtgggtgcaaacgattatttgccatattcaccaaaagccaaagaagttttagcggctgctggggatgaagccaagcggttaggtgcagcaaaaataggaacggaacatttgttgcttgctttattaagtgacgaaaatattctgtcttcacgaattttaattagtttggacatggatcttagccaaactcgcaaagttattttacgtaagttaggcgttagtgcttcggcacagctacggcaaaaccaagcgcaaaatagtcgaggagctaagccaaaaggcacgccaacattggattcagttgcgcgtgacatgactcaaatggcacaagaaggtcaaattgatcctgtgattggccgcgaaaaagaagttaaacgtgtgattcagattttgagtcgccgaactaaaaacaatccggttttaatcggtgaacccggcgttggtaaaacagcaattgctgagggacttgcacaacgtatgattgatggtaatgtgccggatgacttagctaacaagcgattgatgatgcttgacatgggatcgctagtcgccggaaccaagtatcgtggcgaatttgaagaccgtttgaaaaaagttattgatgaaattcatgaagataaacacattgtcttgtttattgatgaattacacacattaatcggtgctggtggtgctgaaggtgcaattgatgcttcgaatattttgaagcctgctttagcacgcggtgaactccaaacaattggggccacaacgcttaatgaatatcaaaaatatatcgaaactgatgcagccttagaacgccgttttgctaaagttgaagtagatgaaccaacccctgaagaatctgttcagattctacaaggcttacgcggtaaatatgaggaacaccatcatgttgaaattactgatgatgcgatcaaacaagcggtcgaactttctgatcgttatattagtgaccgctttttaccagataaggccattgatttaatggatgaagctgctgctaaagtacgaattgaccaaatgggcaaaactgagaaatcaacttctgaaagtaaattacaagagttaacggatgccaaagaagctgctattgaggaccagaattttgagggagctcaaaagattcgggttaaggaagaaaagctgcgtgccaaaattgaaaaagctaaggctactgctacagctgatgatgcaaagccaaagtatcaacttcaagaaactgctgaggatgttgcgcaggtggtttctgagtggacgggtgtgccattaactcagttgcaaaaaactgaaagtgagcgcctagttaatcttgaatctattttgcataaacgcgttatcggccaggaagaagcagtttcggctgtttcacgagcaattcggcgtgcacgaagtggtttaaaggatccaagccgaccaattggttcatttatgttcttgggcccaactggagtcggaaaaactgaactggctaaagcattggccgaagctatgtttggttctgaagataacatgattcgaattgatatgtctgaatacatggaacggtatagtactagtcgtttgattggctctgctccgggttacgttgggtacgatgagggtggtcaattgacggagcgtgtacgtcaaaaaccttattcagttgtcttgtttgatgaagttgaaaaggcccatccagacgtgtttaacattttgttacaggttttggatgatggttatctaactgattctaaaggccgaaaagttgacttcagaaatactattttgattatgacttctaacttgggtgccacagcattgcgagatgaaaagtcagttggctttggtgccaaggatgcgagtgaggactatacggcaatggcagctaagattcgcgaagtgcttaaacaaagtttccgacctgaattcttaaaccgaattgacgaaaccattatcttccattctttgaaccgtccacaacttcataaaattgtgaaattgatggctcgtcagattctgaaacgagtcgcagatcaaggcatgacagtcaaaattacaccagcggcaattgatgcggtggcggaagctggctttgatcctgaatatggggcacgcccaattcgccgtgcgttccaaactaaagttgaagataaactaagtgagttaatgttgtcaggacaggctaaaattggtgataacatcactgttggcgctcgtcatggtaagatccaggtggctgttaaaaatccaaaaccggattcaaaacaaccaacagcctaattgaataaatttgcagttttaatgtttgacagatgataacaaattgagtatgattaactttgtttgtaactgtgaatgaaatggagcgttgcgatctattgtccgtggcgcttttcataaaaaagcaaaaatagctatcaaatttaagagctatttttggtttttttttgccaaaaaacagtgcaatttgtgaaatgtaatcaaactgtaatgtaaaaggccgtttgcggaatattttagagaggtgaataacttggcaggacatttggtaaagtacggtaagcaccgaacccgtagaagttacgcgcggattaaagaagtgctggaacttcctaacttgattgagattcaaagtaattcataccagtggttccttgatgaaggattgaaagacatgttcgatgacattatgccaatcgacgattttgccggaaatctttcactggaatacgtggattatcaattattagaaccaaagtatacagtggatgaggcgcgtgagcatgaagcaaattactcagcacctttgcacgttactttgcgtttaacaaatcatgaaactggcgaaattaaatctcaggatgttttctttggtgattttccattaatgacagaacaaggtacgttcattattaatggtgcagaacgggttatcgtttctcagttagttcgttcacctggtgtttattacactaaggaagctgacaaaaacggccgagatatttggggcacaacagttattcctaatcggggagcttggttagaatacgaaacagatgcaaagaacattgcatatgtacgaattgaccgaactcgtaaaattccgatgactgaattagttcgagctcttgggttcggatctgatgaagaaatcgttgatatgttgggtcaaacagatagtttagataatactttagacaaagatgttcataaaaattctgaggattctcgtgttgaagagtccttgaaggatatttacgaacgtctccgcccaggtgaacctaaaactgcggatagttcacgtagtcttttaactgcgcgtttctttgatccaaaacgttatgatatggctcctgttggccgttacaaggttaacaagaagttaagtttgaagactcgtttagttggtcaaaccttggctgaaactttagccgatccagatactggtgaagttattgtgcaaaagggaactgttgtgactaaagatgtcatgaaagacttggcaccatatttagacaaaaaagattttaaggcaatcacttatacaccatctgacgaatcagttgttacagcaccaatgaccgttcaatcaattaagattgtgaaccctaacgatccagaacgtgaattgacgatgattggcaatgacaacatcgatcttaaattgaaacacattacacctgctgatattatcgcttcaattaactatttcttcttattacaagagggaatcggttcaactgacgatattgaccatttgggtaatcgtcgtattcgttcagtgggtgaattattgcagaaccaattccgaattggcctttctcgaatggaacgtgttgttcgtgaacggatgtccattcaggatgcaacaacagtgacaccacaacaattaattaatattcgtcctgttgtggcttcaatcaaagaattctttggttcttcacagttgtcacaattcatggatcaaactaacccattgggtgaattaacgcataagcgtcgtttatcagcccttggtcctggtggtttaactcgtgaccgtgccggatatgaagttcgtgatgtgcattacactcattacggtcgtatgtgtcctatcgaaacgcctgaaggtcctaacattggtttaattaacagtttggctagttacgctaaaatcaataaatatggttttatcgaaactccttaccgtcgtgtctcatggacatctcatgcagttaccaacaagattgattatttaactgctgatgaagaagatcaatttgttattgctcaggcaaactcaccattaaatgatgatggttcattcgttgatgatgaagttatggcgcgtcatgaaagtgacaatattgaaattagcattaacaatgtcgattacatggatgtttcaccaaaacaagtagttgcggtcgctacagcatgtattcctttcttggaaaatgatgattctaaccgtgccttaatgggagctaacatgcagcgtcaggctgttcctttgcttgacccacatgcaccattggtcggaactggtattgaatataaagctgcccatgattctggagttgcgttgatttgtaaacatgacggaactgttgaatacgttgatgcccgtcaaattcgggtacgtcgtgatgatggtgctttggatacctacaaattaatgaaattccgtcgttctaatggcggtaagaactataaccaacgtccaatcgtgaaagttaacgatcatgtggataatgatgaagtcttagctgatggtccttctatggaaggcggagaattagcacttggtcaaaacccattagttgccttcatgacatggcaaggttataacttcgaagatgccattgccattaatgaacgattagttcgtgatgacgtttatacttctattcatattgaagaatacgaatcagaagcacgtgatacaaaacttggccctgaagaaatgactcgtgaaattcctaatgttggtgaagatgcccttaaagatcttgacgaagacggaatcgttcgaatcggtgctgaagttgaagatggcgacatcttagttggtaaggttacacctaagggagtgactgaattgtccgctgaggaacgtttacttcacgcaatctttggtgaaaaggcccgtgaagtccgtgatacttcacttcgggttcctcatggtggcggcggtatcatccaggatgtgaagatcttcactcgtgaaaacggggatgagctttcacctggtgttaatatgatggttcgggtttacatcgctcaaaaacgtaagttacaagtgggtgataagatggccggacgtcatggtaacaaaggtactgtttccgtagttattcctgaagaagatatgccatacatgccagatggtaccccaattgatattatgttaagtcccatgggtgtgccttcacgtatgaatattggtcaggttttggaattgcatttaggaatggctgcccgtaacttgggaatccatgttgccacacctgtctttgatggtgcccgtgataaagatatctgggatgcggttaaagaagcagggatgcaatcagatgccaagaccgttttatatgacggtcggactggtgaaccatttgaacaacggattgccgttggagttatgcattacatgaagttagcccacatggttgacgataagattcatgcccgttcaatcggaccttactcattagttacgcaacaaccattaggtggtaaagcccaatttggtggtcagcgttttggtgaaatggaagtttgggctcttgaagcttatggtgctgcatatactttgcaagaaatcttgacttacaaatcagatgatgttgtcggtcgtgttaagacttatgaagccattgtcaaaggtgatccaattccacgtccaggtgtacctgaatccttccgtgttcttgtgaaggaattacaagcacttggtctggatatgaaagttcttgataatgataagaatgaaattgagttgcgtgacatggatgacgaagatgatgatgttgtcaatgtggatgcactcagtaagtatgctgaagaacagaaagataaatcaaaagcagatgctaaaacagctgcaactgccaaagatgcttcttctgtaagtgaaacaaaagctgaaacagaaaataataaaaagtaagtttaactagtcaataatcaaatcaagaaggaggtcgatcctttgatcgatgtcaataagtttgaaagcatgcaaattgggctcgcatcccctgacaagatcagaagttggtcatatggtgaagttaaaaagccagaaacgattaactatcgaacattaaagcctgaaaaagatggcttgttcgatgaacgaattttcggaccaactaaagattacgaatgtgcctgtggaaaatacaagcgaattcgttataagggaattgtctgtgaccgttgtggtgttgaagttactaagtcaaaagttcgtcgtgaacggatgggtcatattgaattagctgctccagttactcacatttggtactttaagggtatcccaagtcgaatgggcttagttttggatatgagtcctcgtgctcttgaagaaatcatctatttcgcttcatacgttgtaattgatccaggtaaaacaccactcgaaaagaaacaattattaacagagcgtgaataccgtgaaaaattagaagaatatggtaataccttcaatgccaagattggtggcgaggcaattaaagaattgcttcaagatgttgatcttgaaaaagaagctaaaactttaaaagaagaactcaaggatgcttctggacaaaagcggactcgtgccgttcgtcgtttagacattattgaagcctttattcaatctggtaacgagcctgactggatgattatggatgcaattcctgtcattccaccagatttacggccaatggttcaattggatggtggtcgttttgccacttctgatttgaatgatttgtaccgtcgagtaataaaccgtaacaatcgtttgaaacgtttattagacttgaatgctcctggaattatcgttcaaaatgaaaaacgaatgttacaagaagccgttgatgcattgattgataatggtcgtcgtggccgtccagttgctggacctggtaatcgtccattgaagtcactttcacatatgttgaaaggtaagcaaggacgtttccgtcaaaacttacttggtaaacgtgttgattattctggccgttccgttattgatgttgggccatcacttaagatgaaccaaatgggattacctgtcccaatggctttggaattattcaagccattcatcatgaaagaattagtttcacgtaacttagcttcaaacattaagaatgctaaacgcaaaattgatcgcaaagatgatgatgtttatgatgttttggaagatgttattaaagaacatccagtattgttgaaccgtgcacctactttgcatagacttggaattcaggctttcgaacctgttttggtaagtggtaaagcaatgcgtttgcatccattagtttgtgaagcttacaatgccgattttgatggggatcaaatggcgattcatttgcctttatcagatgaagctcaagccgaagcacgtttgttaatgcttgctgcccatcatattttggctcctgctaatggtaaacctgtggtaacaccttctcaggatatggttattggtaactattggttgaccatggaacgtgaaaatagtgttggcgagggcatgatctttaaagatcttgatgaaattcgtttagctatgcaaaatggctacgtttctgaacatacacgaattgggcttcaagttagctcaatgccaaagaaaccattcactgatgaacaacgcaatcgcattttagtgacaactgctggaaaagcgattttcaatgatattttaccaaagggcttaatttatttgaacgaacctactgatgaaaacttagtcaatggtacgccggataaatatttcttggcacctggtgaagacattaaggcctttattaaagaacagcctttaatcccaccattcaaaaaaggtttcttgagtgatattattgcgcaagtttacaagcaatataaagttacccaaacttccttacttttggaccgtatgaaggatcttggctatgatatttcgactaagtctggattaacagtcggaattgcggatattactgatttgaaagaaaaaccagaaattgtagcagctgcccacaaacaagtcgcaaccgttacaaaacaattccgtcgtggtttaattactgatgacgaacgttatgaacgagttgttggaatttggaacgatgctaaagatgatattcaacaaaaattgatggtgagttttgatcctcaaaatccaatttatatgatgagtgattctggtgctcgtggtaacatttcaaactttactcagttagctggtatgcgtggtttgatggctgctcctaatggtaaaattatggaattgcctattctttcaaacttccgtgaaggcctttctgttttggaaatgtttatttcaacccatggtgctcgtaaaggtatgactgatactgccttgaagactgccaactcaggttacttaacccgtcgtttggttgatgttgcccaggatgttattgttcgtgaaaaagactgtggaactgatcgtggcttaacgatctctgcaattgttgaaggtaatgaagtgattgagtctctgtatgatcgtgtcttaggtcgttacactcaaaaatcagtttataatcctgaaacaggcgagaagattattggcaagaacgaaatgatcgatgaaccaaaagctcaacaaatcattgatgctggtattaagactgttaccattcgttcggcatttacttgcaacactcgtcatggtgtttgtgaacggtgttatggacggaacatggctactggtgaccgggttgaagttggtgaagcagttggtactgttgctgctcaatcaatcggtgaaccaggtactcagttaactatgcgtaacttccatactggtggtgttgccggaaacgaagatattacccaaggacttcctcgtattcaagaaattgttgaagcgcgtcatcctaaaggtcgtgctgaaattactgaagttactggtacagttgagtcagttgaagagaatcctgccgaacgtagcaaagaagttacgatcaaaggtgaaactgatacacggacttacactttaccaattacagcacgcatgaaggttgctgaaggtgactttattcaccgtggttcagctttgaatgaaggttcaattgatcctaaggaattgttgaaggttcgtgatgttctttcaactgaaaactatctgttacgtgaaattcaacgtgtttaccgtatgcaaggtgtagaaatcttggataaacatattgaaatcatggttcgtcaaatgcttcgtaagattcgtgttatggatcctggtgatacagatgtccttcctggtactttgcttgatatcaacgatttcaaagatgcgaactacaagacattgattgccggtggtattccagcaactgctcgtcctgttcttctcggaattacaaaggctgctttggaaacaaatagtttcttatcagctgcatcattccaggaaacaacacgagtattaactgatgctgctatccgtggtaagaatgatccattagttggtttgaaggaaaatgttattattggtaagattattcctgctggaacaggaatgcctgattatcgtaagatcattccaaagaccgttggtggaaaagtggccgaacctaagtcactcagtgatgtcgaaaaagaaatggatacagaaacaactaaatagtgtttctaatctgataattaaaagcagaacttgagccaaatcaagttctgcttttttgttgcaatttttaggctgaaattaagagatagccaaaagttaaataaggaataaatggaattttacgcgcatgtaaatgcggaaaacagagcgttagaattaaacaaagggtagaggcaagacatagaattgaagagatgacttgtaaacgggaaagaatgatgaagacaaatactagttcaaaatctgcttcaccgaatcctttaataaggtttgaaaattgaaacgacgaaaaaacgcttagcattaaagccagaaatatcatacagtttagtatcgtaaattgaaagcttaatcctaatatacctaaaacaccaagaaagtagccattcacatatgtttgtttaaaatctatgagacttaaataaattaatacggtgacaacgaaaagttgaaagaaaaattttaatggttgaaatgtgaccgtgaaaacatgcaagtaaaggatgcccagaactaattccacacaacatgaagtgggtggaaacctttggtgacagtaacgacattgaccatttagccagcaataactaaaaattggaattaaatcaaccggtttaagaatggtttggcagtttgaacaatgagaacgaggtttgatgatagactgcttcgtttccgcacggtcgatacaaagtgtcaaaaaggagccaatggtagctcccgtgataaaaaagtaaatttgaataagcatttaattacctccgatattaataagttacgaaaatttgattgacttatttgacgataaaataagttttaatttttaatttgatggcatagaatgtaaaacaggtgacaaagcccgtgaaacaaggagaagactcgaatttattttggaaaaaagtttgacaaggcatgctgatgatgataatctaagaaaggtgctttttgtggacaggttctgtattagacagacatgctgactggaaacggtggcacaaagccatgttgaggcggttttttttatcaataaaaaagacccacctggatgtgtgtacttaaacaaacaagattttttattcggaaggggaaacaattaatgcctacaatcaaccaattggttcgtaagggtcgtcattcacacggttctaaatctaaggctcctgctttaaattatggctacaacagtatgaagaaaaaagctgttgctaacccagcaccacaaaaacgtggcgttgcaactcgtgttggtactatgacacctaagaaacctaactctgctttacgtaaatatgctcgtgtacgtctttctaacttgatcgaagttacagcatatatcccaggaatcggacataacttacaggaacatagtgttgtgctcattcgtggcggtcgtgttaaggatttacctggtgtacgttatcacgttatccgtggtgcacttgatacagccggtgttaccgatcgtaaacaaagccgttctaaatacggtacaaagaaacctaagaagtaaggaggttatttaaatgccaagaaaaggccctgcatcaaaacgcgaagtattacctgatccaatttacaactcaaagttagtaactcgtttaattaaccatttaatgttagatggtaaacgtggtacagcttcaaaaattctctataatgcattcgacgtcatcaaatctgaaactggtaacgaaccaactgaggtatttgatgaagctatgaagaacattatgccagttcttgaagttaaggctcgtcgtgttggtggttctaactaccaagtaccaatcgaagtacgtccagatcgtcggacaactttaggacttcgttggctcgtgaactattcacgccttcgtggtgaacatacaatgacagaacgtcttgctcgtgaaattatggacgctgcaaataatacaggtgcttcagttaaaaagcgtgaagatactcatagaatggctgaagccaaccgagcatttgctcattatcgttggtaattttccgcttgttgcttaatccaacatgtttggaaagagcaataacgaatggctattatatgaagtccatatagtagtcattttttctaattttgactctttaaccattaatttgaagggagaaacattttttaatatggctaacaaaagagaatttccacttgaaaagactcgtaatatcgggatcatggctcatatcgatgccggtaaaacgactactacagagcggattttgtactacactggtaaaattcataaaattggtgaaactcatgatggggcttcacaaatggactggatggcccaagaacaggaacgtggtattaccatcacttcagctgctactacagctgcatggaaagaccaccgtatcaatattatcgataccccaggacacgtggacttcactgttgaagttgagcgttccctccgtgtgttagatggtgctgttgccgttcttgacgcccaagctggtgttgaaccccaaactgaaactgtttggcgtcaagcttctgattacagtgttccacggattgtttttgcaaacaagatggataaagtcggtgctgactttgacttctctgtacaaacaatcaaggaccgtcttcaggctaatgctttgccaattcaaatgccaattggtgctgaagatgattttgaaggggttattgacctcgtcgaaatgaaagctgatctttacgatgaagaccaactaggtactgaatgggatacagttgatgtgcctgatcaatataaagaagaagctgaaaagcgtcggacggaaatgatcgaacaattagctgatatcgatgatgacatcatggaaaaataccttggtggcgaagaaatcagtaaagaagaaatcaaggctgctatccgtaagggtacattgaatcttgaattattccctgttttagctggttcagctttcaaaaacaagggtgttcagatgatgttggatgctgttgtagattacttgccatctcctttggatgttaagccatacaacgccatcaatcctgaaactgatgaagctgttgaattaactgctggtgatgacaaaccatttgctgccttagcatttaaggttgcaactgatccattcgttggtcgtttgacttatattcgtgtttatacgggaactttaaaatcaggttcttatgtattgaactcaacaaaagacaaacgtgaacgtgttggtcgtttacttcagatgcattctaatcaccgtcaagaaatcccagaagttttctctggtgatattgctgctgcaattggtttgaagaacacaactactggtgattcattgactgatccagatcatccactacatttggaatcaatggaattccctgatccagttatccaagttgccgtagagccaaaatctaaggctgaccaagataagatggatattgcgcttcaaaagcttgctgaagaagatccaacattcaaggctgaaacaaaccctgaaactggtgaaactttgattgccggaatgggtgagttacatttggacattatcattgaccgtatgaaacgtgaatttaacgttgaagcgactgttggtgctcctcaagttgcttaccgtgaagcattcactaagccggcttctgcacaaggtaagtttgttcgtcagtctggtggtaaaggacaatatggtgatgtttggattgaattcacacctaatgaagagggtaaaggattcgaattcgaagatgctattgttggtggggttgttcctcgtgaatttatcccagctgtagaacaaggtttacgtgaagccataaataacggtgttcttgcaggttacccattggttgacttgaaagctaagttatatgatggtagttatcatgaagtcgattctagtgaagcagctttcaaggttgccgcatcaatctcacttcacaatgctgctaaaaaggctgctcctgtaattttggaacctgttatgaaggttgaagttcgtgtaccagaagagtacatgggtgatatcatgggtcagattacagctcgtcgtggtcgtgttgaaggaatggaagctatctcaggcgctgaagaaattcatgcctttgtaccactttcagaaatgtttggttatgcaactaccttacgttcagcttcacagggtcgtggaacattcacaatgacatttgatcattacgaagcagttcctaagtctattcaagaagaaatcatcaagaaaaatggcggttcttcaagtaaagactaatttctaatttagaataaattaaagctcattagccgcagtgtaaaaactgtgattaatgagctttttttgtccccaatagttataaagattaaatgatcttggcgcccaaagaatttttgaaatgggttagtgcccaattatgcccaacctgatcaaaactagcgaccgcattttgtggaatcgtaagttgataattaagattataggcagaaatggccgtatgcaaaacacaaatatcggtgcaaacaccggttaaggtgagtgagttaatcttatgtgtgcgtaaaaagttatcaaggttagtatttacgaatgcgctatatctgttcttatcaaaataataaacttgttggctagttgcatgtgattcataccaaggttgaactgtattataaagttgccgtccccaagtgttttttaaattgtgtggtggaaaaagtttcgtttcaggatgaaagagatcgttcttttcgtgcagatccgtaggaaaaatcacataattgccggctttaatgaattggttcgccagttttaaaatttctggttcaattttttggcctggtttacccgtactgagcgcaccagagtcggcgacaaaatcgtttgtataatctataataagaagtgcttctggatttttcattgcaattcctccaatctttagtcctcattatgaaacataaatcgttttcaaatgttacaaatatattacattttttcaaacccaaaataaattggcagaaagccttgtaaaacggctatttatctagtagtatggacaagtacttgaaatttaacgggtgtactatgcccattaatcaagtcaaaacaaggagctttgatgtgaaaggttgcgacacacccggccgctttgccacgacagtgtggcggtaattttcacggagcaagtctcattttcaaaatagacgaaggaggtaacacaatggcaaaacaaaaaattcgtatccggttaaaggcatacgaacatcgcatcttagatcaatccgcagataagattgtcgaaactgcaaagagaactggtgccacaatttctggtccaattccattaccaacagaacgtacaatctatacggttttgagctcaccacataagttcaaaaaagcacgtgagcagttcgaaatgcgtacacacaagcgtttgattgatatcgttaacccaacaccaaagacagttgactcattaatgaagttagatctgccaagtggcgttgatattgaaatcaagctttaatttctagaaacacaaatttagtatcacaataatattggaggtgtactcatgaccacaaaaggaatcttaggaaaaaaggttggtatgacccaagtctttactgataacggcgagttagttcccgttaccgttgttgatacaacaccaaacgttgtattacaagttaaaaccgttgaaagtgatggttataacgcagtgcaattagggttcgatgacaaacgtaaagtattgagcaacaagcctgaacaaggtcatgtagcaaaagcaaatacaaatcctaagcgcttcattcatgaaatcagagatgttgagctgggagaattaaaagtcggtgacgaattgaaggctgacttattcgcagcaggcgatatcgttgatgtcacaggtacttctaagggacatggtttccaaggaaatatcaagaaggatggacaacatcgtggtccgatggcacatggctctcgttatcatcgtcgtccaggttcattaggtgcaattattaaccgagtgttccctggaaagaagttaccaggtcgtatgggtaacaatacacgaacagttcaaaacttagaggtcgtaaaggctgatacagaaaacaatgttttattgatcaagggtaatgtcccagggtcaaagaactcattcttagttgttaagaatgcagttaaaccacacaaaaagtagaaaggaggactaaattaaatgacaagcgtatctttatataaacaagatggtacgaagaatggcgacgttgaacttaatgctgacgtttttggtatcacaccaaacgataatgtgatttttgaagctattgttatgcaacgcgcatcaatgcgccaaggcacacatgctgttaagaatcgaagtgcagttcgtggtggtggtaagaagccatggcgtcaaaagggtactggtcgtgcacgtcaaggttcaatccgttcaccacaatggcgtggcggtggtattgtgtttggccccacacctcgctcatatgcatacaaattgccaaagaaaatgcgtcgtttagcgttgaagtctgtactttcacaaaaagtattggatgacagcttggtagttgttgacggttacagctttgatcaaccaaagactaaagcatttgcacaatcacttgacagcttaaaagtttcaacgaaagcattattagtccttgaagaagataacgaagcaactgctcgtgcagctcgcaaccttgaaaacgtcaaaattgtttcaccaactggtgtaaatgttttagatgttgtcaatagcgacaagctcgttattactcaaaaggctctttctcaagtagaggaggctctcgcataatggaatcacgtgatgtaattttacgtccagttgtcactgaagcttcaatggcagaaatggacaataaacgttacacattcgatgttgacactcgtgcaacaaagacagaagtcaaaaaagctgtcgaagatgtctttgatgtcaaagttgttaaagtaaacattatgaatgttaaaggtaaactcaaacgtcagggacgttattctggttataccaagaaacgtcgtaaggcaattgttacattgtcatctgactcaaaagaaatcaaattattcaacgaagaataataaataaactataggaggaaaaaacacgtggggattaagaagtttaaaccaacgacaaatgctcgtcgtggcatgacacagcttgattatagcgaaatcaccaagacgactcctgaaaaatcgttactcgaatctcaaagccacacagccggccgtaataactctggtcgtatgaccgttcgtcatcgtggcggcggtaacaagcgtcaatatcgtattattgatttcaagcgaatcaaagatgatgttgcagctactgttaaagctattgaatatgatccaaaccgtacagcaaacattgctttacttgtttacgctgacggagttaaatcatacattattgcaccaaagggccttaaggttggcgacaaagttcaatccggttcagatgctgatattaaagttggtaatgcattgccattaacagacattcctgttggtaccattatccacaatatcgaattaaagcctggtaagggcggtcaattagcccgttctgctggtgcttcagcacaattattaggtaaggaaggcaaatatgtcttagtacgtttggcttcatctgaagttcgtatgatcttatctgctggtcgtgccacaatcggtgctgttggtaatgaagaacatgaattaattaatgttggtaaagcaggacgtactcgttatgctggccagcgtccacacgttcgtggttctgtaatgaaccctaacgatcacccacatggtggtggtgaaggtaaagctccagtcggtcgtccatcgcctctatcaccttggggtaagaagaccattggtaagaagacacgtaacaagcggagtaaatctaataaatttatcgttcgtggtcgtaaacgtggtcgcttaggtaatatttagtcgaaaatttccctaaaggaggtttcataatgagtcgtagtttgaaaaaaggaccatttgcagacgaacatcttttaaagaagattgatgcacaaaaagatcaagagaagaagtctgttattaaaacatggtcacgtcgttccactattttcccaagtttcatcggttatacaattgctgtatatgacggcagaaaacatgtcccagtttacattcaagatgacatggttggccataagcttggtgagtttgttcctacacgaacattccatggacatggtaccgacgataagaagacaacagttgctaaataaggaggatgaatcatggctgaacaagtaacatctgcacatgcaactgcaaaaactgttcgcattgccgctcgtaaggttcgtttagtaattgatcttattagaggaaaaagtgtcgcagaagcaattgcaactcttaagttcacaccaagaggtgcatcgccagttgtagaaaaagttttaatgtctgctgtagctaatgcagaaaacaacttcgacttagatcgtgaagatttggttgtaagtgaagcttatgtcaacgaaggaccaaccttaaaacgtttccgtcctcgagcaaaaggttctgcttcaccaatcaacaagcgaacaagtcatataacagtagtcgtatctgaaaaataggagggaacacgcgtgggtcaaaaagtaaatccaaatggatttcgtgttggtgtcatccgtgactgggaagcaaaatggtatgctgaaaaagattttgctacctatttacgtgaagatttacaaatccgtaaattcatctcaactaagcttgccgacgcatctgtttccaatgttgaaatcgaacgtgctgcaaatcgcgtgaacatttcaatccatactgctaaacctggtatggtcattggaaaaggcggatccgaagtagaaagcttacgtaaacaattgaatgaacttacaggtaaacgagttcatattaatattattgaaattaagaaacctgatttagatgccaaattagttggtgaaaacattgctgctcaattggaaggccgtgttgctttccgtcgtgcaatgaaacaagctatgcaacgtacaatgcgtgcaggtgctaaaggtatcaagacacaggttgcaggacgtttgaacggagcagatatgtcccgtgtagaacattattctgaaggaacagttccattgcacacattgcgtgcagatgtagattacgcttgggttgaagcaagtacaacttacggtcgtttaggtgttaagacttggatctaccgtggagaaatcttgccagaagctcggggttccaaaggaaattctaaagagcaaggagggaaataatcatgctagtaccaaaacgagttaagttccgtcgtgtgcatcgtggtaagatgcgtggtgccgcaaagggcggtagaaccgtcactttcggtgattacggtttacaagctttagattctcattggatctcaaaccgtcaaatcgaagcagcacgtgttgctatgaaccgtcacatgaaacgtggtggtaaggtttggatcaaaattttccctcacaagtcttacacttctaaaggtgtaggtgttcgtatgggtaatggtaaaggtactcccgaaggttgggtagcaccagtgaaacgcggtaaggtaatgttcgaagtcggcggtgttagtgaagaagttgcacgtgaatcattgcgtcttgcttctatgaaactacccgttagaacaaagattatcaaacgcgaggaagtaggtggcgaatcagatgaaggctaaagaaattaatgaattaaccactgatgagatgctaaaaaaagaacaagattataaagatgagctttttaacttacgttttcaattagctactggccagttggaaaatacagcccgtttaaaggcagttcgtaagaacattgctcgtattaagactgttttacgtcaaaaagaattaagtaagtagaagaatacgaagggaggaacttaacacatgagtgaagaacgtcacgctcgtaaagtatatcaaggccgtgttatttctgacaaaatggataaaacaatcacggttcagattaatactaccaaaaagcatcctgtttatggcaaacgtgtaaaatattcgaaaaaatataaagcacatgatgagaataatgaagctaaggttggcgatgttgtaagaatcatggaaacacggcctttgtccgcaaccaaacgattccgtttgcttgatatcgttgagaaagcagttactatctaaatttgttatttttatttcgtattctgatacaaaaatggaaggaggacactaactgtgatccaacaagagagtcgtttaaaagttgctgacaattctggtgcacgtgaaattttggtaatcaaggttttaggtggatctcgagtaaaatttggttatattggtgatactattgtggctactgtcaaacaagcaacaccaggtggcgttgtcaaaaaaggtgacgtcgttaaggcagttgttgttcgtactaaagacggtgcacaccgtgctgatggctcatacatcaaatttgatgaaaatgctgcagttttaatcaaagatgataagagccctcaaggaacacgtatcttcggacccgttgcacgtgaattgcgtgacaaagattacatgaagattgtttctttggcccctgaagtattgtaattaacgatcggatcgaaggaggtgcgacacggcatgttcgtaaaaaatggtgataaagttcgcgtaattagcggaaaagaaaaaggcaaagagggcacaattattaaaacccttgctaagaaaaatcgcgttgtggttgaaggccttaataaagttaaaaaacatcaaaaagcaagtaactctaaccctcaaggtggaattattgatgtagaagcagcaattgatgcttctaacgtgatgttaatcgatccatcaactaatgaacctactcgtgtaggctacaaagttgtagatggtaaaaaagtacgttttgctaaaaaatctggcgaaacaatcgacaaataattcatgaaaggaggaaaaatttttcatgtctaaccgtttaaaagaaaaatacgttaaagaagttaccccagaactcgtgaagaagttcgattatacttcagtaatgcaagcacctaaggttaacaaaattgtcttaaacatgggtgtcggtgatgcaacaactaatgctaagaatcttgacgaagctgttgaagaattaacattgatctctggtcaaaagcctttggtaacaaaagctaagaaatcaattgctggtttccgtttacgtgaaggtatgtcaatcggtgctaaagttacactccgtggcgaacgcatgtatgatttcttagataaattgatcaatgtgtccttaccacgtgttcgtgatttccatggtgttagctcaaaggcctttgatggtcgtggaaactatacacttggtgttcgtgaacaattaatcttccctgaaattgattatgataatgtcaaccatgttcgtggtttagatatcgttatcgtaacaactgctcaaacagatgaagaatcacgtgaattattggcacaacttggaatgccattcgaaaagtaaacgaagggagcaataaatttggcaaaaaaatcgttagttattaagagtcaacgtcctgcaaagtattcgacacagaactacactcgttgtgagcgttgtggccgtccacactctgtatatcgtaagttccatctttgccgcatttgccttcgagaattagctcatgaaggccaaatccctggcatgaaaaaagcaagctggtaaaaagtataccggagtaaaaggagggtaaacattaatgtctatgactgatcctattgcagatttcttaacacgtattcgtaacgccaacatggttcgtcacgaatctttagaagttcctgcatcaacaatcaaacatgatattgctgaaattcttaagaatgaaggctttatcaagaacgtcgaatatgtcgatgacgacaaacaaggtattattcgtgtgttccttaaatatggtaaaaacaaagaacgtgtcattactggcttgaagcgtatttcaaaaccaggtttacgttcatatgtcaaagctgatgatgtaccaaaggttttgaatggtttgggtattgcaatcatttcaacatctgaaggcgtaatcactgataaagaagctcgcgctaaaaaaatcggtggcgaagttttagcttatatttggtaaaattttaaaagtaaggaggtgcagttaaattgagtcgtattggttataaagctgtagaaattccatcaggcgttgaagtcaaagccgatggtgatcaagttactgttaagggtcctaagggaactttaactcgtactgttagcacagaaatcacaatgtctattaaagacaacgtggtaaaatttgaccgtccaagtaatgataataaaatgcgtgccttacatggggcaactcgtgcaaacttcaacaacatggttgagggagttacaaagggttacaaaaaggacttacaattagttggtgttggttatcgtgcacaacttaagggcaagacattagtattgaacttaggttattctaatcctgttgaactagaaactcctgctgatttacagttggaagttcctgataacacacatatcactgttagtggaattagcaaacaacatgttggcgattttgctgctgagatccgtgccgttcgttctccagaaccttacaaaggtaaaggtgttcgctatgttggtgaatacgttcgtcttaaagaaggtaaaactggtaagtaatgccgcttaggctagttaatagaaaattctagaggtgaaaattgtgatttcaaaaccagataaaaataaaacacgtcaaagacgtcatttgcgtgttcgtaataagatttctgggactgcagagtgcccacgcttaaatgtatatcgttcaaataaaaacatctacgctcaagtaattgatgacgtagcgggtgtaacgctagcaagtgcctcaactttggacagtgaagttagtggagattcaaaaactgatcaagcaagttctgttggtgctttagttgcaaaacgcgcaacagaaaagaaaattgaaaaagtcgtttttgatcgtggcggatacttataccatggtcgagtagaagctttagctgaagctgctcgtgaaaacggacttaaattctaagataaggagggaataccgtacatgtcgaattatatcgatccagaaaagttggacttagaagatcgtgttgtttctatcaaccgtgttactaaggttgttaaaggtggtcgtcgtcttcgtttcgctgctttagtcgttgttggcgataaaaagggtcacgttggttttggtactggtaaagctcaagaagttccagaagccattcgtaaggctgttgaaactgctacaaagagtttgatccaggtcccaattattggcacaaccatccctcacgaaatcatcggtgagtttggtggcggacgaattctattgaaacctgctgaagaaggttccggtgttgcagctggtggtgctgttcgtgccgttatggaacttgcaggagtagatgatgttacaagtaaacgtttgggttcaaatacacctgttaacgttattcgtgcaacatttgaaggtctgaagggcttacgtagtgctgaagaaattgcttcattacgtggtgtttcagcagagcacttggctgaataaggaggaacaaaagatggctcaattaaagattacacttatcaaaagtgcagtacatcgcctccccaagcaacgcaagattgttaaagaattaggtttgggacgggttaatagctcagtcgttttacctaataatgaggcgactcgtggtgcaattttccatattgcccatttaatcgaagttgaagaagttaaataatttaaattagttaggaggtgccgatacttatgaagttgaatgaattaaaacctaatgaaggttcacgcaaagtgcgtaatcgtgttggtcgtggaacatcatctggtaatggtaagacatctggtcgtggccaaaaaggtcaaaaggctcgtggcaaggttcgtttgggctttgaaggtgggcaaatgcccctttatcgtcgaattccaaaacgtggctttactaacatcaaccgcaaagagtatgccattgtaaatttggatagcttaaatgcctttgatgaaggtacagaagttacaacagaagtgcttttaaaagccggcgtaattaataaagtgcttagtggtgtcaaagttttaggtgacggtcagttatctaagaagttaacagttaaagctaataagttctcagaaagtgcagtaaaagcaattgaagctgcaggtggcaaaactgaggtgatttaatgctatcgactatcaaaaacgcttttaaagtaaaggatattagaaacaagattctatttaccctaggtgttttgattatttatcgtttaggtgcgtatatcacagttcctgggattaacgccaaagcattacaaagtgttgcttcctctggattggttggcatcttaaatacctttagtggtggtggcctatccaattattctatttttgcgatgggagtttctccatatattactgctcaaattgttattcagctgttgcaaatggacatcgtccctcggtttgttgaatggagcaaacaaggtgaagttggccgacggaaattaaatcaggcaactcggtatttgaccattatattggcattcgtgcaatcggttggtatcactgcaggatttaatgcgttaagcagtctgaatttggttaaggatccgagcattcaaacatatgcaacgatcggattaatcttaactggtgggacaatgttagcaacctggatgggtgatatgatcaccgatcgggggcttggtaacggagtttcaatcttgatttttgcgggaattatcgcgagaactccaacaagtatttatcaaatttatcaagagcagtttgtagatactgccaaaagtcagtggttaaacagtttcatttttgttgctgttttgatcgtagctgttttggtaatcgtgatttttgtaacttgggttcaacaggctagtcgccgagttccaatccaatatacaagaagagcatcgggtgcgcctgatagcagttacttacctttaaaggttaacgtagctggtgttattccagttatctttgcaagttcgtttattgcaacgccacaaaccattttgatggcattcgcaagtaaccactcctcagatacctggtatcaagttttgtcggatgtgtttaatatgcagacgacagatggagccatcctgtataccttcttgatcgttgtctttactttcttctatgcttttgttcaggtcaatcctgaaaaactagcagagaatcttcaaaaacaaggaagttatattccgggagtttggccaggccatgaaacgcagagttatgtgtctcatttgttaattcgtttatcagtcgttggatcgctattcttggggttagtttcactaattccgttattggcacaagacttctggaacttggatgaatcaattggtttgggtggaacaagtttgttgattgtcgttggtgtggctattgaaatcatcagtcaaattgatggtttaatgatgaaacgcgaatatgttggttttatcagaacaccagaacaaagcaattaaagtggaggtaaacaaaatgacaactcttaatctcgttttgatgggattaccaggtgctggtaaaggtacccaagcacaaaaaattgttaatgaatttcacacacttcatatttcaacaggagacatttttcgggcagcaatgaaaaatggtaccgaaatgggaattgaagctaagaagtttattgaccaaggcaatttagttcccgattctgttactgatggaattgtggaggatcgtcttggagaggatgataccaatgcgggctttatgctagatggttatcctcgaaatcttgaacaagctaatgctttggacaagatgacagctaagctaaataaaccgattaatgcggtaattaatatccacgttgatccagaagttttagttgagcggttgtctggtcgattcatttgtaagaattgtggcgcaacataccataagttgtataacccgccaaaggttgaaggcacttgtgatgtttgtggacaccatgaattttatcagcgtgatgatgataagcctgaaactgttaaaaatcgtattgaagttaatacaaagttaaatacaccactgattgatttttataatgacaaaaaattattatatacagttaatggtgatcaagatattgacgatgtatataaagaaattcaaaaggtattacgagctatttaatgtatgcctgttcattattgccggttaattttgtttatttgcaaatgaaattaccttatggtaagcttgttcaggtttagcttatggtacttttgcgatacaataagcactgaacgactgattttgtaaagaaaagaacagtaaaatgggaggcacatttagtggcaaaagataatgtcattgaaattgaaggtaaggtaaaagaaactttaccaaatgcgatgtttaaagttgaactcgaaaacggtcatgaaatattggcacacgtttctggaaagattcgtatgcattatattcggattcttccgggagataaggtaactgtggaaatgtcgccatacgatctttcaaagggtcgtattacctatcgtttcagataagttttaacgttttaggaggaatattcatgaaagtacgtccatcagtaaaaccaatgtgtgaacattgtaaagtaattaaacgtaaaggacgcgttatggttatttgctcagcaaatccaaaacataaacagcgtcagggaaaataattaatctggaggtgaaatttaatggctcgtattgcaggtgttgatttaccacgagacaaacgaatcgtgattggtttaacctatatttttggtatcggaaatactactgctaaaaagattttaaaggatgctggcgtctcagaagatgtccgtgttcgtgacctttctgcagatgatgaagctaaagttcgtgcacaagtagataactaccgtgttgaaggagatcttcgtcgttcagtaagtcttgatatcaaacgtctccaagaaattggttcatatcgtggcatgcgtcatcgtcgtgggctcccagttcgtggacaaaacacgaagaacaacgcacgtactcgtaaaggcaaaaaagtttcaatcgccggaagaaagaaataataaataaaggaggctagcatattggcaaccagaaagactactcgtaagcgtcgagtaagaaaaaatattgaagctggtgtggcacatatccactcaacttttaacaatacattagttatgattacagatcctcaaggaaacgctgttgcatggtcatcagcaggttcacttggattcaaaggtagtcgtaagtcgactccatttgctgctcaaatggcttctgaagctgcagcaaaagcagcaatggaacatggaatgaaatccgttgaagttgctgttaagggtcctggttctggtcgtgaagctgctattcgtgctctccaatctactggattggaagttactgctattcgcgatgttacaccagttcctcataatggttctcgtcctccaaagcgccgtcgtgtatagtgcgtcaattttttgagggctaacttcatgatgcatttcaagttactatgcacaacgcgttttgaaaggggtaaagattagaatgatcgaatttgaaaaaccaaacattcataagattgatgagaatgcaaattacggcaaatttgttgtagaaccacttgaacgtggttatggaacaactttaggtaattcattacgtcgtattttgttatcgtcattgccgggtgcagcggttacaagcattcaaattgatggcgttcttcatgagttttcaacgattgaaggcgtagttgaagatgtcacacaaatcatcttaaacattaaaaaggtttctttaaagattgaaagtgacgaagaaaaatctttggaaattaatgttaaaggacctgctactgtcactgctggtgacattcagggcgacagtgatgttgagatccttaatccggatcagtatatttgtaccgttgctgatggtgttacctttcatgccgttttaacagctgatactggtcgtggttatgtttcggctgatgaaaataaggctcgcaaggatgatatgccaattggtgtacttccaatcgattccatttataccccaatcgagcgtgtcaactatcaggttgaaaatacacgtgttggtcagcgggatgactatgataagctcacattggatgtttggactgacggttcaattagtcctagtgaggctaccagtctttcagcaaaaattctaacagaacacttggcattgtttgttaatttgacagatgaagctcaagatgctgaaatcatggtcgaaaaggaagaaacacataaagaaaaaatgttagaaatgtccattgaagagcttgatttatcagttcgttcatacaattgtttgaagcgtgctggtatcaatactgttcaggaacttactgacaaaactgaagcacagatgatgaaagttcgtaatcttgggcgtaaatcccttgaagaagttaaggttaaattaactgatcttggactttcattacgtaatgaagactaattataaggagggtttccattcatgggctatcgtaaattaggtcgtacgagttcacaacgcaaggctttgcttcgtgacttaactactaacttaattgttaatgaaaagattgtcacaacagaagcacgtgccaaagaagtacgatcaactaccgaaaaaatgatcacattaggtaaacgtggggacttacatgcacgtcgtcaagcagccgcttttcttcgtaatgtagtcgctgatgttgctgaagacggtgacgaagttaaaattacttcggctcttcagaagttgtttggtgatttatctactcgctacgctgatcgtaagggtggatatacacgaattcttaagactatgcctcgccgcggagacgctgcactaatggttatcttggagtttgttgactaatttccaaacaaagatttttgaatctttgatttaacaaatttatcactaaaagttgtggtagggtgtaatgatggtggaagtaattccgagtctagcccacggttaatacgttgtattaactatcacttcttttcagtgatttttttgtatctacataaaaaagaacgtatactagggtgcaggtttttgatatgttaaaatagaaaaaataactttagaaggaatgtttgcaatgaacaacataattaaggtatccaatttaacttataagtattcgcaaagcgatcagcctgcattaaatgacgtttcttttgagattactgatggtgcttgggtagcgattgttggtcataacgggagtggtaaaagtacacttgctcattctttagacggtttaattgacttcaaacaaggaacaattgtggttgatggcgttgaattgaacgaagctaatgtttggaaggtccgtagtaaaattggtatgatctttcaaaatcctgataatcagtttgtgggcgcgactgttgaagacgatgtggcatttggcttagaaaatatggcggtgccacatgaagaaattcaagctcgtgttgattctgcactgtcacaagttcagatgagtgcgtttcgtcataaacaaccagagcaactttcaggaggacaaaaacaacgggtcgctttagctggtgtgattgctatgcagcctaagattattatcttggatgaagcgaccagtatgctggatccgattggtcgtcgagaaatcctgggagtcattaaacgtttacgccaacgattaggcattaccgttttgtctattacgcacgaaattgatgaaaccactagtgcagacgaaattctagtgttaaatgatggcaaaattgtggaaacagggacaccggaagttatttatgcccatagtgagttactgttgcaattaggattggatgtgccatattcgcaacggctaaaaactgcactgcaaacgaggaatattcacacaccaaaaacttattctgatgagaaaggcatggtggattggttatggcaatcacttttaaaaaggtaagttatacctatcaacccaacacaccatttgagtatcaggctctaaacgagatatcaactcatattgaagacgggtcatttacggctttgattgggcatacgggtagtggtaaatcaacatttttacaacatttgaatgcactgttaaaacccagttcaggaaccgttttaattggtgattcttctattacaaatgaaaccagcaataagaatctgaagccgttacgcaaaaaagtagggattgtctttcaatttccagagaaacaactttttgcggacactgttggaaaagatattgcgtttgggccagaaaactttggcagtactcctgaagaagcgcatgagcttgcaaagaaaatgataaaactagttgggttgtcagaaactttattggatcgttctccttttgagttgtcaggaggtcagatgcgacgggttgccattgccggggttcttgcaatgcagccagaggttttagttcttgatgaaccgacagccggactggatccaagtggacgtcaagagattatgcaattatttacaaacttacagcaaacgcagcactttacgattgtgttagtgacacatcaaatggaagatgtcgccaactatgcgaatcatgtgattgtgatggaacatggcaaaattgtgaaggagggcaacccgcgagcggtctttgcaaacgttgagtggttgcatgataaacaattagatgtgcctgctagtaccgaatttgcttttgaaatgcagaaaaaaggttttcgttttgaccagctgcctttaacagaacaggagttggcggatgacattgcggccatgtttgaaaagagaggactagccaatgaataaactattatttggtcgctatattccgcaagactcttttgttcatcatatggatccgcgggcaaagcttgttcttagttttttgtacgtgatagttattttttttgccaataattggtggatttatctgttaatgacgttagttgcaattctaagtatttgggcgtctaagattaactttaaactgtttgtcgatggcatcttgccgttggtgtggattatcgcctttacaatgcttattcaagtcttttttggaactggtgggcatttatactggcaatggggtatcttttccatcacgagcctaggaatccttaatgcggcgtatatttttgtccgtttcacgttaattatcttaatttcgacattattgaccctctcgacttcgccaattcagatttcggacgccattgaatctttgttgaaaccattagcgaaaattcattttccagtctatgaagtggcgttgatgctctcaattgctttgcgatttgtgccaacgttgatggatgaaacggaagccattatgaatgcccagcgtgcccgtggggttgattttggaacgggcaatattgtgaaccggatcaagaaaattattcccattctgatcccacttttcgtgagtgcttttaatcgagctgaggatttagcaaccgccatggaagctcgtggctatcaaggcggagcagggcgaacaaagtatcgattattaaaatggggaacaagggacacaatcgcgactttgatttatttgttaatgacgatgattgtgtttgcactacgtttcttttaaggagaatttatgtatcgttataaaattacaattgcctacgatggaactaattttgcgggttttcagaaacaaccaaaacaacgcacagtggaagaaacgttggaacgtgcagttaataagattgccaaaaagccggttaaactgataaaagtctacggttctggtagaacggatgccggcgttcatgccttgggccaagttgtccatttcgatatcccttttaatttagcggagactgcaatgctacatgcgctgaacagcattttaccgttggatgtcgtggtgttgagagctgaacatgtgacatcagagtttcatgcacgctatgggacagcaggcaaacggtatcagtatcgattagctttaggagaatttgtggacccgtttaaacgtaattataccggtcactggaagtttccactggatttgaaattgattcaaagggcgttaccagatttaattggaaaacatgattttaccagtttttgcgcgtccggtgggcacaccaagaccaacattcgagaaatctatgaggctaccgctgtctttgatgagaaacaaaatgaaattgtgtttgaattttatggcagtggctttctttataatatggtgcgaattatagtcgccgttttgattgagattggtagtgaacggcgtcccgtccatgatatttcacgaataattgaagctaaaaaccgggatgaagcccgtggaacggctccagcaagtggactttatttaaaaaaagtgtattacccggaaaattttggtaaatgatgattgactttagtgaaggtaattagtaaaattgaatttggtattgtttacctccacaaataggccccggaaacttattaaagttgagttaaacaaaacagaaattggaggaaatacaagtgcgtacaacatatttagcaaaaccaggcgaagtagatcgcaaatggtacgtagtagatgctacagatgttcctttgggacgtttagcaagtacagttgcatctgtcttacgcggtaaaaacaaaccaacattcacaccaaacgttgatacaggtgactatgtaatcgttgtgaatgcagcaaacgtcaaattaacaggtcgtaaagcgacacgtaaaatttactatcatcattctaatcacccaggtggcttaaaagctaagactgctggtgaaatgcgtgataagactcctgaaaaattaattgagacttcagttaagggaatgcttcctcataactcactgggtcataatatgggactcaaattacatgtctatgctggctcagaacatgatcatcaagctcaacaacctgaaaagcttgacatcactaacttaatttaaggaggaaacgaattttggcagaagcacaatatcgcggcactggtcgccgtaaaaactctgttgctcgtgtacgtcttgtacccggcacagggaaaattactgtaaatgacaaagcgattgaagactacattccattcgctaacttacgtcaagttgttatccaaccatttgaagttaccgaaacaactggcaattacgatgttctcgtaaatgttaatggtggtggcttctctgggcaatcaggtgctattcgtcatggaattgcacgtgcattgcttgatgtagatcctgacttccgtacacctttaaaacgtgctggtctcttaactcgtgaccctcgtatgaaggaacgtaagaaatacggtcttaaaaaggcccgtaaagcaggtcagttctcaaaacgttaaaattcattcttttcaatgtttcagacacttcttctatgcgaagaggtgtttttttataaaaaaataagttatcactcagacagtttccgaatgcgattacgcgcagagcaagaaactgacaggtgataactttttgaaaaactatttatttatggatgcgtttgtaatttttatcaaaatatttacccgcacgaatgtcagctggtaattctggatagggggcttcactaatgacgtcttcattgttttggcccgcatcgccaatataagtgatgtgtgcaaattctggaacgactaatttaggataagtttcatatttttctcgagaaacttccatgagatcaatgtgatcgttttggtaagttaccgtaatttcgggatgttcttgaacccagcgagggaaaaagatggttccgttaagtttcttttcattaggaacgaagtcaagcgcaacatcggttccagttggctcagtccaggcgaccttgtaaatcccaggaacaagcatcacaatgttggcttcttggtctttaacccaacggccggcaaccataccgccatggattcggtagtcaacggtatggtcattttttgcgtaccattcatattcccagccgttatcgtacgtatagataaaatgagtgcctaaaaaatcgtctaatgttttaaatgtttttgtcatgagtcaaattcctccaataataagtaatcatgtaattaattacatgtttttgatgacttgatcatgctacaatatttttaacagttcgtcaaggaggatgcataaatggctcaaaagaatcgcttaaagtatattttattaggattgcttaagaagcaacgtcagactggctacgaccttgcgaaatcatttgattcggacattggagagttttggacggcaaatcatagtcaaatttatccacttttgaaacggatggaagctgatcacctgattgcgcatgaagccatcacggtagggcaaaaactgcaaaaaaagcagtactacatgacctcggctggtcagcaaacatttaacgcatggctgaaatcaccatcggatttgactggaagccatgatgaatttattttgaaactattttttattgacgatccaaagtcggagttacttagaccaatgattacaacgcaacaacagtatcatgatgaaaaattacatcatttagagcaacaatttcaggagaagtttccgaatcaaaaacgaattgatcaagattttgggcattcattagtattacggcatgcaattgatcgcgaacgcggatatagcaactggttggctgaaatggtgcaaacaattaaaacggaatgattaaaacaaaggcctgacatcggtgttcgatttgagaagcaaaattgacattttcttagatattgattagaattaaacattatgtctaatcgaaaaccaataatgattggagcaaagttatgtcaagaggtagtaaatttgcggatttgtttgttcgtaaagaagttaatactgatatgtttaaaaagactggattggagaaatccttaaatgcctttagtttaacaactatgggagttggcgcgattgtcggtgctgggatttttatcactccaggaattattgccgcatcctatagtggtccaggcgtttggttatcttatttagtggcagcaattgtctgttccttagcagctttgtgttactcggaattttcatcaaccattccattagctggaagtgcgtatacgtatatctacactgtatttggagaactaattgcttgggtgcttggatgggcattaatttcggaatatttgtttgcagtttcgtcggtggcagttagttggtcagcctattttcaaaatattctcgccggttttaaaattcacttgccagaaatttttcgggcagcttatggtacttctggtagtccccatgcgatttttgatttaccagcttttgtgattacaatgatcattgcttatttactggtccaaggcgtgcgtgaatctgccagagttaatgccgtgatggttattttgaagatttcggtgattttactttttatcgttgtcgccgcgttttatgtgcgtcccgctaattacaatccaattttacctttcggagtgaaaggtgtgatcagaggggctgcggttgcgttttatgcgtacattggttttgatgcagtttctacggcgtcagaagaagttaaaaatccgaaacgagatatgccaattggaattgtttcttcactgattgtggcttcagtcttatatattgcgctttctgtggtgttggttggtgttgtccattacaccaaactcaatgtggctgatccagtggcactagctttacatctgattcatcaaaactgggtggccggcattgtttcacttggggcagtcatcgggatgaccacggtgctaattgtgatgtcttatgggggaacccggttgatttttgcgattagtcgggatggtcttttaccaaaggcgttacataaactaaatcctaaaacgcatgtaccagtaattaatacctggatttttggattgatcgcaagtatttttgcgggtgtgattccattgagtaaaattgcggagttggtgaatatcggaacgttgtttgcgtttgcgatggtgtcattgggcgttgtgtttttgcgaagtgatcgaaagtttagaaatttgcctaagtcattcgaggtgccgctgtatccgtttattccaatattgtcgtttgcggcatgcgtgtatttgatgttgcagttggcgccatttacgtggaagatgtttggaatttggctagtgatcggattggtgatctactttagttatggattttcgcatagtattgcaagaagaaatgaagaaaagagtgtggaaaagcacggttagactgtgagtattagcccaagtcgctaataagctttgtgcttcggtcgttgaccattcttgtggccgaaaagcagaccgcaagaaggcatggcagcggaagagtctgcgcattggaacacgtttcagataaaaaaggactgaagaaaatattttttcttcagtccttttaaaatacgaagaaaccaatcaccgtttttgcagactataatatcaagcatcaatacccatttttcatattcactcgattagtagccacggtgccgtccttcataaattgttctagatttggtagcaagattttgtcccaggcacgacctaaatgaggcattttcgcagagtagtgtggcgtgaccaatacattgggcatttgccacaatggactactgctcggcaaaggctcttgctcaaatacatctaatgctgcgtgctgaagatgatcagaatgcaacgcttcaatcaaggcagtcgtatccacagaaccaccacggccaacattcacaaacaaataagccgattttaagaaatcaaaaaaggttttgtcatagaaatgagcagtttctttagttaatggcatgatgtttacaatgacatctgtatccgccacggcttttcgccagtcactttgggcataggtttcgtcaaaattggcagctgagtggccagtacggttgacaccaatcactttggcatgaaatgactttaacaggcgggctagttcgctaccaatatggccagtcccaaaaatggtccaggttaggtcatcgagggtaaccacctcaccaaaattatgttgatcagtccagtgcttttgttcagcatcagccaatactcgtggtagatcacgggcaaagtataacgcataaagtaaaatagtctgtgaaatagggatggcgtgaacaccactcatatttgagaccagaatgtgttttgctttcaattgagcaagcggtaaataatcaacgcccgcactaaaagtttgcagccattttagggaactaccagtagctgttaaaacttttttggaaatatcaggtttccagccgaacataatggtgatagaagcatagtcgctcggcttaatggttgcttcagtaaaaatgtgcacacctaaatttaggtaggcgcttaaatttaattctgaattatctgttaaaagtaaaaggttctccaaaccttaacaactccttataaagtggtttgtagttaattttttggtcacttacatggtataatgtttcttaacaattatgaaatcaaatggctttttatcttgtgagggacaacaatgggaaaaaattctgcaggtcggattagtattttaggattgtttgcggcaatcatcatccttcaaaattatgtaccaataattgggtatttaccagtcggaccactaaatattaccacgattcatattacggtaattattgccgcggtggtgcttggaccggttgatggggccattattggcggcatatggggtatcgcggattggattcgtgcgttaacagttacctcgagtgtgttaggtaacattgtaatggttaatccgctcatttcggtcctgcctaggattctgattggtttaattgctggttggctatttacaaaattggcacgtaatcacgccaaattaaccgtaccgttagtgataagtggtgtggttggggctttggtcaatacgatcctagttttaggaggtattgccttcttctttggtaagggttctgcagtgttagcggccatcaattttcaggcgctaacgccgtacattttgtttgtggcaggaactaatgggattccagaagcaattgcggctggtattttagtacctttaatctcgttacctcttctgaaatataccaagttgggaaaacaacgatttaataaataatgtagaaagatggatgaatttggcgaaacgaaaaaagcgacgaaagaacaattttttatttaaacgaggtaaattacaattatctggggttatttcgctggttttagttttaggtatgctgatcgtgttgtttgtgcaattggtgcctaagctttcgttttccaattcaacgccggcaactaatttgagtacagttaatcatcaaaaatttattcggaccatggcaccgtatgccaaaacaatgcagaaaagatatggtgtgctcccaagcattacgattgcacaggccattttggaatccgactgggggactagtcagctttcgaaagactacaacaattactttgggatgaaggggaccgtctaccaaacgaccaaggaaatgaagactcaggaatttgtgaatggtaaatggattaccgttaccgctcgttttcgggtgtacaatagttggaaagattctgttaaagaccataccttactatttgtgaatggaacgaactggaataaagatcagtataaagcagtccggacagcgattaactataaaacggcggctcaggcactttacacagcaggctatgcaaccgatccgaattatccggcaaagttgattgatttgattcagacctataacttagagcaatatgatgcacaataaaactatttggaggcactattttgaaattattagaagaccgcattcgtaaagagggaattgttcttccccataatgttttgaaagtagacagctttttaaatcatcaagttgatccgcaactcatgtttgaagtgggcaaagaatttgcgaagcggttcgcagataaaccaatcacaaaaattttaacggttgaatcttcaggaattgcaccagcagtgatgaccgggttagctatgcaggttccggtaatttttgcacgaaaacataaaagtctgacgttaactgatgacctgtatactgcggatgtgtattcttacacaaaacaaaccacaaataaaatttcgattgccaaacggttcatcagtgcagatgactctgttttaattattgatgattttttagcaaatggtcaggccgtccaaggattgttgaacattgtgtatgaggccaacattgaagtgcaagggattggcattgtcattgaaaagactttccaaaaaggacgaactttgatcaccaaacgaaatattcagttggaagcgttagcgcaaattagtagtttggaaaatggtgaggtccaatttttaaattaatgcaaaaacccagtgaatatacttgccaacgaaggacgacaacagtaatattaaggttgaagtcattatgatcggtaaaaagaatgaaaagaaatttgcacgttaatgggtgcataagaatgggtgggctaaatggcagtagcaagtaatgcaacgttatatcctggtgatactttgggaattattggggatagtacaaatggttcccaactaatcacagcggcacgtcgtttaggtcttcgggtgattgcatatggcgcaaacgaagtcagtgaaactatgcaattagcagatgtacatatcgttggtgaaccaaacgatggtaataaattacgtgaatttggcgaaaaatgtgattctgtagtttatgaatccgaacacgttgattcacaaacacttaaatatctagagcagtttacgaaaattccgcagggaaccaatgctctagaagtcacccaagatcgtctaattgagcgtgccttttttgatcaacttaatttaaattctgcaccgtacgcgacggtgattagtttgagtgatatttacgaatccattaattcaattgggtatccaagcgttttgaagccaattcaaaagagttttgaacccaacacggaattacggatcaacacgcaaacagatatcccagcagcagcagacttattaaatgagcggacttacattttggaatccacagttgattctcagcaggaattggtccttactgtggtgcaagggatgaatggcgaacgtaaaatttttccgattgcagaaaatgtgtatgcccaagaacacttggttgaaaccattgtgccggcagttgtttctgatagcgtccaaaatgagctattgcgaattacaaatgaagttgctgatgctttggaatatgtgggtgtgtttgaaatttcgtttgccgtgactagatcagaagacatatatgtcaatcgaattgtgccagccattcatcgtcccggctatgtgttcaatcgggctacaaatgtgagtgtgtttgaccaacatctacgagcaattgccggaatgccacttagtgatatcaagttattcatgccaagcattatggtgaactttgataagagtcagatggaagcaattcggacacagtggaacatcaaaaataattggtatttccacatgtacgcccaaaataaaacaactgaaaaacaaacccgtgccggctatgcgttagtggaagccaactctacacagcaagcacaagaacaaattgataatacagagatttgggcgaatcacccaattatcgactttgggaaagcagaataaagtcagtaatctttagaatcaggataagaaaactttgtcttgattcttttttgtgattatgcaagaaatttaggttattttggccgggaaggtcaagtatgcctcactttttggtataattaagggtaattgagttttttgaatagaattggttttggatagagaggattgaaacttttggccgaaaataggttattaaagggtctaaatgacaaacagaaagaggcagttcaggcaactgaagggccacttttaattatggcgggtgctggtagtggtaaaacccgagttttgacgcatcgggtggcttatttgattgaagaaaaggccgttaatccctggaatattttagccattaccttcacaaacaaggcagcaaaggaaatgcgagagcgagttgttaaacttctaggtagtgccggatctgacacatgggtttcaacattccatgcgttgtgtgtcaggattttaaggcgcaatattgatcaaattgggtataatcgagcgttttcaattgctgataccagtgaacaacggacgctgatgaaacatattgtgtctgagctaaactacgatcctaagaaatttgatccaaaatcattgttgtcagctatttccaatgctaaaaatgatttgttaacgccacaagaatataaagcaaacgctaaaacaccgtttgaagttgtcgtggcagcggcctatgaagaatatcaacgccgtttgaaagttaatcaggctttggattttgatgatttgattatgcaaaccatcctcttgttcaaaaaaaatccagaaacactgagttattaccaaaataaattccactatattcatgttgatgagtatcaggatactaatcaggcccaatacacattagtcaacatgttggcaaaacggtttgaaaatatctgtgttgtgggtgatgctgatcagagtatttatggttggcggggtgctgacatgcaaaatattttaaattttgaacaggactataaaaatgcccaggttattttactggagcaaaattatcgttcaactaaaaaaattctggatgcagcaaactctgtgatcaaaaacaataccacccggcgacctaaaaagttatggacccaaaataatgaaggcgaagatattacttattaccggggccaaagtgaaaatgatgaagtgcatttcattgtgcaacaggtgaaacaacaaattgaagataatcattatcaatatggcgactttgctgtgctgtaccgaacaaatgcgcaatcacgagccgttgaagatacatttttaaaatcaaatgtaccgtacacaatggttggtggtcataagttttatgatcgaaaagaaattcgggatgttttgagttatttaacgttacttgccaatcctgatgattcgatgagttttgaacgggtgattaatgaacctaaacgtggaattggaaccagctcactcgaaaaattgacggattttgcaaattacaatcactggtccctgtttgaagctgctcaaaatgtggaagtggctaatgaaattgcgagtcgcgccaaaaatgccattgatgagttcgcaggtattatgaccgatttaaaacggatggcagaattcttgaacatcaccgatttaacggaacaagttttagacaaaacgggttacaaagctgaacttgagaaatctcgttctctagaagctcaaactcgtttagaaaatatcgaagaatttttgacagttaccaaacagtttgatgatagtcatcaagatgacgaagaaacaactgcggaaacacgtttggctgatttcttagctgacttagcgttagtttctgatcaggatagtgtggaagaagaaccttccgcagttacgttaatgactttgcatgcggccaaaggacttgaatttcctgttgtgttcctgattggaatggaagagggaatcttcccactagcacgagcggcgatggacgaagatcaactcgaagaagagcgccgtttagcctacgtgggcatcacgcgtgcacaaaagaaactttacattaccaatgcatattctcgaatgctgtatggtcgtttacaaaataacccagcatcaagatttattgaagaaattgatccagatgttttggagtctgctaatcaaacagctggggctgcaccaagtgggtatgccaatcggcagaaatcatatccatttgatcgtaaactagaacgggcaactgctacaacatatcatcgaccagccgctaaaccacaaaagtatgctggtactggagctgacaaggttagttggtcagcgggtgataaagtgcaacacaaagcttggggtgttggaacagttgtcaaagtaactggcgaaggcgaagatgcagaattagatattgcttttccagatcaaggtgtcaaacgactgctggctgcttttgccccaattagtcacgtctccaaagattaaatgttaattttcaagtaataaacggcttatctatagaaaagaccttgacagtttttcgatttaatcctcataattcaagagtgaattatgattgaaatgggaggaaatacgcggtgaatctaaagaaaagtttgcttggcattgcagttgtgtttagcgcagtggtcctagcatcgtgtggcagtagcagtaataaatcaagttccagttcaagtagcagtaaaacgaccacaagttctaagagtggcagctatcaagtgacgggtcaaacaaatgattcggaatatgcgggtgtgattaagaatggaaaatatttaaccagtaaatcacgtggtgtaactgctaatcaagattctaatttaatgaatttgaagagttttgaaactggcttgcaggacatttcaaagacacaattttcaaccaccaagtatgtgttccaagaaggccaatacttatctaagagtaccgttgaaaactggcttggtcggaaaacgaaatccaatacaagtggtttgaatccagcaagcaacgggtcaacggaaccaaccaaacgaaatccgatttatttgcagagtattgaagaacaagattacatgcaaaagagtggtagcaagttgaagttgagtgggatcaccattggcttggcgatgaactcagttgattattatcgaaagaccacttatggtgctcagtacgaaactgatattagtgatgcaactctggaaaaagagggaaaagccatggccaaagaggttttggctcggttacgtaaaagggcggctcttaagaatgtcccaatcgtgattgccctgtataagcaggcttcaaatgatagtttaatcggggggcattacgtcacttattctgttagcaatggcgattctattaagaagtggaaagctttggaaattcaaaatgtggttttcccacttaaaacgggggaaacggcaccgaataccaatgatgccgatgcgttttcaaacttcaaatcagaagttgaaagtttcttccctaacttgagtggtgtcaccgcccaggcacagtataagaatgggtcgttgcagggaatgaacgtttccatcaccacccaattttatagtgaaactgaaattaagagttttacgcaattcttggcagatcaggctgaaaagtacttaccaagtggtgtaaagacagatatcacggttagttcaacgaccgatggggtccaaagcttcctaagtcggaagagttctggcaagagctttaccacccatgtttttggtagctattaggcggtaagggtacttcttataagccacagaatatttatggtaaaataatttgatagatttgaaagaaggataacacatggcaaacgaagaaaaaattgataaggcccaagtagagcacgttgccagtttagcaaaattggaatttaacgatgctgatttgggtaaatttaccacacaattagccgacattatgggattgttcaacacgttaagtgaagttgacacaactggtgtcgaacccacatttagtgtaacggatcaatttaacacaatgcgtgaagatgtggctgttaacagtcatgaaaaagacgccttaattaaaaatgcgcctgatactcaggacggttatattcgcgttcctgcaattattgatgaaagtgaaggtgccaactagatgaattattacgatactgatttaactacgttgcatgaaaagctggtcaataaaaaactgactgctgaacaattaactcgcgacacgttggctaaaattaaagctgataatgaagcgatcaatgcctatattacaattgatgaaaacgcagcaattgaaacggctaaggctattgatgctaaaggaattaatcctgataacctttgggctggtattcccattgctgtcaaagataacattgtgacaaaggggttgcgaacaactgctgcatcaaaaattttggagaacttcaatcccatttacgatgctacagtgatcgaaaaactccgtgccaatgatgtgattgtgattgggaaaactaacttggacgaatttgccatgggtggttcgaccgaaacgtcttactttaaaacaacccggaatccttggaacttatcgaaagttcctggtggttcttcaggtggttctgctgcaaccgtttctgcaggaggcgttttagctgccttaggaacggatactggtggttcaattcgtcaaccagcttcattcactggtgtcgtgggggtcaaacctacatatggccgtgtgtctcgttggggaatcatcgcatttggttcaagtttggatcaagtgggtccgttcacacgtacagttaaagataatgctgctttattaaacttaattgccggtcatgatgagcatgatatgactagttctgataaagaagtgcctgactttactgctggtttagatggttcggttaagggcatgcgaattgctttaccaaaagaatatttaggtgaaggcgtcgatgaaaacgtcaaaaaggccgttttagatgctgccaatacattcaaagaacttggggccactgttgatgaagtgtccttaccacacagtaagtacggtattgctgcctactacattatcagttcttctgaggcttcttccaatcttcaacgttttgatgggattcgttatggattccgtgcaaaagacgtcaaaaacttggaagacgtttatgtgcgttcccgttcagaaggttttggcgatgaagtcaaacgccgaatcatgttaggaacttattctctttcagctggtttttacgatgcttacttccgtaaggctgctgaagtccgaactttaatgattaacgacttcaagaaggtctttgaagatcatgacttcattattggaccaactgcaccaaccccagcatttggcattggtgaagattccaatgatcctaaaaaaatgtatatgaacgatgtgttgactgtgcctgttaatatggccggtctacctggaatgtcattgcctgctggtttcagcaatggtttgccagttggtttgcagattattgccaagccatttgatgaacaaactttgtacaaggcaggttatgctttcgaacaggcaactgatttccatagcaaaacccctgagattggaggagacaaataatgaattttcaaacgacaattggacttgaagtccacgtggaattaaagacgaattctaaaatttttagtccgtctcctgtagaattcggggatgatccgaatgcaaatactaacgtcattgattggggctatcctggtgttttacctacaaccaacaaaggcgtagtggagtccggaatcaaagctgctttggctttgcatgcagaaattgaaaaacataatcattttgatcgtaaaaactacttctatcctgataatccaaaagcctatcaaattacgcaatctgacaaacccattgcccatgatggctggattgaaattgaagttgatggcgaaaagaagaaaatcggaattgctgaaatgcatattgaagaggatgccggtaaaaatacccataatccaaacggttactcctttgtcgatctaaaccgtcagggaacgccactgattgaaatcgtgtcgaaaccggatattgcttcacctgatgaagcttatgcttaccttgaagctttgcgtcaacgcatccaatttacaggtgtttctgatgtgaagatggaagaaggttccatgcgggtggacgtcaacatttcgattcgtccttacggttctgacaagtttggaaccaagactgaattgaagaacttgaactccttcagttacgtccgtaaagggttagcttatgaagaaaaacgccaacaacaagttctgctatctggtggtaccattcaacaagaaacgcgtcgctttgatgaagcaactggccaaactattttgatgcgggttaaggaagggtccgacgattatcgttacttcccagaaccagatttgcctgccttatctatcagtgataactggattcacaatattgaagaagcaatgcccgaaatgcccggtaaacgccgtgcccgttacgttagtgagttaggtcttaaggattatgacgccatggtgctaacccagaccaaagaaatgtctgacttctttgatgaaacggtcgcaaatggtgcggatgccaaaatggcagctaactatctgatgggtgatgtaaatgcttatctgaatgatcaacaagttgatttacaagacactaaattgacaccggctaacttggctgcgatgatcaagatgatcagtgatggcacaatttcaaccaagattgctaaaaaagttttcaaagcattgacaaagggtgaagaaccagttgcctgggttaagagtaaaggcttgatccaattatcagatcctgcccaattacaaccaattattaaaggcatcgtggatgataatcagcaatccgttgacgattttaagaatggtaaagatcgggccgttggctatttagtcggtcaagtgatgaaacagactcatggccaagccaatccaaaagttgttaacgagcttttgatgaaagaattaaataatcgttaatcagattttctcggaggaaccaaaatgcaaagaagagcacgcgtcatttataatccaacttcagggcgtgaaatcttaaaacaaaatatgatcgacattttgagtgtgtttgaggaggccggctttgagtctagtgcttatgccacaactcctgaaccgaattctgctcaaaatgaagcccgccgagcggccaaagctgggtttgatttaattgtggcggccggtggtgatggcacaatcaatgaagtcgtgaatggaatcgcggatctgcactttcggccgatgatggcgattattcctgctggtacaaccaatgattatgcccgtgccctgaagattcctcgggaagatcctgtagcggctgccaaagtcgtcttgaaggatcaacgaattaaaatggatattggtaaggctggcgacaattattttattaacattgctgctggtggattgctgactgaattgacctatgatgtcccatctaacatgaaaagtatttttggctatttagcttatttagtgaagggcgcagagttgttgccccaaattaaaccggttgatatggacattgaatacgatggcgaacatttcaatggtaaagcctcaatgtttttcttggctttaacgaattcaattggtggttttgaacaaattgtgccggatgcttcgctagatgacggtcgatttaccttgattatcgtgaaggcctcaaacttagtttcaattctacatttgatggttaaagctttgaatgggaatcatatggatgatccgcgcattatttatcgcaaaccaaaacgtgtcaaggttaatccagtcaatgatcgcgtcatggtcaatattgatggcgagtacggtggggatgcgccaatggtgtttagaaatttgcataaacacattgagatgtacgcaaaccttgataagattccggatgacgcttataatttaccagagccaggggtcgcaaaagctgaagagaactttgtcaaacaagttaagaatttgcctgacgaagatgaagattaaattttaagaagccgtccttgaatgtgaggtctttgatacccataattcaatgggacggttttgtgatagttacttgaaaaagaaaaatgaggacaaatatgaaatttaaagcaccagttaccaaaaatgaaacgtacgatgtgacgatcatggacttgacttatcaagggatgggcgttgccaaaattgaggattttccaatcttcgtggcaaacgctttgcctggcgaagagattgctatgaaagtaatcaaagtagctaagtcttatgcctttggtcgtgtccaagcatggaaatctaagagcccagatcgtgttgagcttaaggataaagaatatacccaaaccgggattgcacccttacagcatttggcttatcctgcccaattggaatttaaacaacatcaaattcaagagttattttataaagttcatttggatgatattgaagttagtccaacaattggaatggaaaaaccttatggttatcgaaacaaggcccagatcccggttcgcagtgtaaatggtcagttaacaactgggttttatcgccgtaacagccatgatttggtaccgattgaagatttttacatccaagatcctgaaattgacaaggctatcttggtggttcgtgatattttacgtaaatatcatacagcaccatacaatgaaactaatcatactggtgtgattaaaacgatcatggtgcgtcgtggccattactctcacgaaatgatgattgtgttgattacccgggcaaagaaaattccgatgaacttcgagattgtggaagaaattcgcaaacaacttcctgaagttaagagcattattcaaaatgtgaaccccgctcagaccaacgtcttgatgggtaaggaagaaaagattttatggggtagcagtgtgattcacgacaccttacttggtttgaaatttgcgatttcggccgattcattctatcaggtgaacccagttcaaactgacaaattgtacgatctggcgattcaaaaggccggtttaaccggtaaagaaactgtgattgatgcttattgtggaatcggaacgatttcgttagccgtggctaaacatgccaaaaaagtttacggtgtcgaagttgtcgagaaagccattcaagatgccaaaatcaacgctaagttgaatgacattcataatgtgaagttttcggttggtaaggctgaagaaaaaatggctgattggcaacacgatggcttgcaacccgacgtgattgtggtggacccaccacgcaaaggtttagcacccgagtttattacagctgctgcagagatggcaccaaaacgaattgtctatgtgagttgcaatccatcaactttggttcgggatgtgcaaacatttatggataatggctaccatgtttctcaaccagttgtgcctttggatcagtttccccaaacacctcacgtggaatctgtgacggttttggaacaagataaatagtgctttaatttattaaaaataaacagatgaccatttaattcaaggctattaagctttaaattaaatggtcatctgttttttcatatttattgacgataatattttttagtcaaatagtacactggaaccccaagtagagttactatcatcccaatcatagctagttcaaactgggtcacgatcgtggttattaatataaagaaaccacccacaatggcaattatcggaattaccggatagccgggaacccgatacggccgtttcaaatctggttcgcgttttcgcaaaataaatacggcaataaaaattagcagactgaagatccacatgacaaacacaatcatatccgtcaaaagatcaaagttgcccagaaacatcatgagaagagcaattgcaaactgtaaaataccggcaccaaatggcgcagcagtgtgcttgctgactttacgaataaaaccactgaatggtaaggtctgctcttcggccattgagagaggaacccgcataccagtcatcgtataaccattaatggcaccataaactgagatcaagattccaatggtgaccaatttaccacccatcacgccaaacaatttaatggcagattcagatgccgcatttaaattaccggcaaggtgcgaaatggggagggtttttaagaacactaaattgattaaggtataaataattgtaatgaatgctaatccccagccaatcgctcgtgggagatctttttcaggatgtttcatttcacccgcaattgcaccgacacctaaccagccatcgtaggcaaacatggttgctaacaagccactagaaaatgctgaaaatagacttgtatgtgcagaagcagttggtagtaaatccaaatttgtggaactcggcgcgaataggcccactaacacaataatggctatcggaatgagtttaaaaatcaaggccattgattgaaggcgaccagctgctttggttcccaaaaagttgattagtgtaatggataaaccggccagaattgctactggtagttgaacagaatcccttaagtgcagtagcgctacaatttgggttccaaacacaatcgataaagcagcaatgttagctggaaaatagatcaggctttgagcccagccaaataaataagctggcagtttgccataggtgtattccaaatacttgaccgcaccaccagttaaaggaagcgctgcggccagttccgcacttgtgagccctgcacaaatagtcaacagaccgccaagtacccacgcaattagggttatgcccgtggattgggttgcgctcactacgctagcaactttgaaaaataccccgccgccaataacagtccccatgaccgttgcgagggcagtaaaggtgccaacttctttttttaatccatcgttttcttgttgcatcagaatgcctcacttttttcaacaattcttccattatagcagaagacaccatgaggacaaacgagaaactcatcaaaaatggaaatggtgtacaatagggaaaacggaagtaggggatgaattgatttggctaagcaagatatcaaaccgatttatagtaccacctataaacataaacgaaactggcattggcgcagatggctggcactgttactaattattttactggtagtagcgggcatcaccggctggcatttttggcgacaatatcaaactcaagctttacagaaatatccagttcagggcattagcgtatctcagacggatgggttcgttgattttcaagccgttcaaaaggctgggatgaagtttgcctatttaaaaacaacaagtgggacaacgtattttgatgatgattttgcggcaaattatgatcgtattcaaggatcagatttgaaagttggcgtttatatgatgtttagcttcaacaaatctgctaaagagcaggcaaagtacttcattaaaatggtgggtcacaaagttggtaatttgccaatcgcgattcaagttcaatactatggcaactatgcggataatccgccgaatagtgcgaaacaaggcaaacagttacgtgaactgacaaacgagcttgctaattactataccgcgccatgtattatttggacgacaccgacaattgcaaacaagatgattacaccatatttatcggatagtcgacaatggttgattgtggacggggctagtgagctaaacaaactgaaaataacgaaacaaactgaattcgtgcaatacagtgatgcagctgacttaactgtttctgggcaaaaaattaagtttgtcacttctgtgtttaccgggaagaaacagacttggcaagaagttgaataattttagaaaataataaaacgattgcggcaggcataggagcttgcgtggtaatcgtttttttgtgtggtggattgtttcctagctttatagccgaaatgtgttccgcaaggcagcttcctccgcatagctacggagagacaacaattccaaacccgaatcattatctctccgtagttaatgctcagaagctattcgccttgctccacactctattttgttaccttataatttcccctcaaaatcgggtacgtctcattctccgtctcatcataaatcgataccggacgctcatcattcgctcttattcgaatatggtacccataactatccagaaaagtgatggtatacttatcccaattttcaaccttagccttaattggccggttatcaatcagtaaatcaaaatttggtcgaatttcaattgtgtggatccgtctcgaatcatttgtacgataattccaggtgcccacgaaaaacaaaggattctctggtttttctgaaacgtcattttcgtgcagtttccttgaggctaaaattcccgtgacaaatgacgctgcaaacaatccaatacttttaagcttcaccatcatcaaatcctttccgataaaaatttctactctaagaatagcatttttatacggcaaaagcatgtaattctgattaaactttaccgatttttagaatggatcgtccttttaaatatacttaccctagaaacactgataaaataggaaatgaagaatcaaaattggagggcggattatgattaaactgggaattatcggaacaaattggattacacagcagtttgtcgatgcggctcatgccactcaagaatataaattaaccgctgtttattcacggaccattgaaaaagcaaaaaaatttggtgaaccaaatggcgccaccatctttttggatgacttagaaacattttttgccaatgacgacattgatgctgtctacattgcttcacccaacagtttgcactttgaacaagccaaattggctattgaacatgacaaatcagtcattattgaaaagccaattgtttcaaacatcaaacaaatggagacgttacgccaaacgttggaacaacatccgcaatcacggttgtttgaagccgctcggcaaattcatcaaccaaactttaaagtcgttgaggatcaaattgccaaacttggccgggttcaaggtgcaacgctaacttacatgaagtattcgagtcgttatgacgctgttttggcaggtaaagaacccaacgttttctcgttgaagtttgccggtggtgctttacaagatcttggtgtttacgtggcttatgatgcagtcggttggtttggaatgccagatgatgtgacctattatccatctctggaacctacccgggttgacggcaagggagtcgcaattttgagttatcccgaatttgatgtcacgttgaacattggcaaaaccagcaattcttatctgccatccgaaatttatggcctgaaagatacgattgtgatgaataatccagctgatttggaaacggttagctatcatgatgctgtggggcacgaaactttgattagtgaaaaagttgcggataatccgatggtcgatgaggccaaagattttgcccgtgttattaataatccgcaagataaagtcaatgaccaagattactggaaatggcttgatttaagtcaaaacgtcaacaagttattgtataacctccgtcaatccgctaaaattgttttcccggatgataatcaataaatagacaggtaaggggaaaaaatggatagggtattcgaacaattttttcaaaaacaaggattcaaagctcaaacggcgattcaaaaggccgtttatgagccattaaaggaagaccgctcgttaatcgggttagccccaaccggttctggtaaaacactcgcgtttgccgtaccgttgctagagaagaccgttcctggtggcagtacacagattttgatcttatcaccttcccaagaattagcggtgcaaaccacggatgtcttccgtcagtggggagccgtgaacaacattaaagccacttcactaaccggtggcgcaaacatgcaacgccagattgaacgacttaaaaaacatccggaggtggttgtcggaacgcctggacggatgctatcgctgattcacgaaagtcgtttgaagcttaaagatattcagacgatcgttgtggatgaggcggatgagttgctaaacggtgaaacgctagatgaagtctgtgaaattgtgatgagtgcccctgttgatgtccagctggcattcttctctgcaacccaggccaatactgcggaaaaactatctgaaatttttggcgtggacgttgaacagtttgatgtgcgccaaacggacgacacacaaggtgaagtgattcacgggttagtccgggtggcttcgaataaaaaggtgacttatttacggcgtttagctaaactcaaacattttcaagcgttggttttcttcaatcatgtgtccactttggaacatgtcgctgctgaattaaaacaccaacacatttcgagtgtgaagttagccgggcaccaagtccaaacggagcgggcaactgccatgcgacttttccgtaaaggggatgccaagttactgttaacgacagaaatggctgcgcgaggattggatattcccgatttgccagccgttgttaattttgatttacctcaagatgcaactgcctatacgcatcgaacgggtcgaacaggtcgaatgggtaatgaaggcatgattgtgaacatgggtgatgatcatgatttgcgtgatttgcgtaaactggtgccaagtgtgacattcaaaccgttgttcttacttcatggcaaactcacggaccaaagagaagtcttgactgatgatgagccagaaagtagtgaggcaaaggctacagaagctgtgatcaccaagccaagtgtaaacagcaacgaaactgtgactttgtatccaatgcctaaaaaggtggttaagaaacgtaccacgaaacccaaaccagctaaaccagcatttgttggtgggaagccgaagaaaaagattaatcataaaaagcattctaagaaaaaaggaatgcggcatagaaatattgaaaaatttgaataaggaagtaaacaaaatgacaacaccattaaaaactttaacaattgccggcagtgatacaagtgcggctggtgggatgcaagcagatttaaagacctttgaggaatttggtacttatggaatggtcgccttaacttgtatcgtgaccatggatcccgaaaattggaatcatcatgtgaaccaagtcgatcctcaacttttaaaagatcaattagcaaccgtgtttagcggtggtaatccagatgcaatgaagacagggatgcttggcgatcagactacagttgaaattgcgtatcatgcgatcaaggatcatcagttaaaaaatgtggtgattgaccccgtgatgatctgtaaaggtgaaacggacgtcttaaatccagatgcggcaaacgccattcgggatttattgatgccagttgctgatgtgacaacgcctaacctgtttgaagcgggtgtgttgtcggaaatgggaactttgcataatcttgatgagatgaaacaagctgccaaaaagattcatgaattgggcgccaaaaatgtcgtggtcaagggtggtaaaggtttagatagtgccgaggcagttgatgtcttttatgatggaaaagcatttgaaactttgtcttcaacaaaacaagcaactgatcgcaatgccggtgctggctgtacgtttgccgcggcggtagttgggggacttgctaatgggttgagtgtggcagatgcggttcacttagctaagaaatttgatacggcagccatccaaaatgggtttgacctgaataagtttttaggtcccgtatttcatcctgcttaccgaatgaaaacggttggaaagttggtttagatttttattatgaaaatgtaacattttgaagaatcagacaaatactgtcatattatgtatttatatttaccaaaaataaaagaagcaaccgttttctgaaaatgaaaatggttgcttcttttttactggttttcatacgcgatatgacgcattgaacgcattccaaaaaaatgatagacttagtttattgatgtattttaatataaggcgggtaccggtatgaaaagattcttgaagtggtttttttcgattgtacttgttctggtcgtttttgcaggcggtggttttgccttagctaagtacaacacaaatagcatggctcatcactattatgaaaagctggttggggccactgaaaaggccacgggtgctactgatacagttaagaccatatatcaagtgccagtagcaggtaaaaatgattcggcagcaaaaaaagtagattcagcgatgaaagctaatcgaatttccggatcagtgattattgttcggaacggccaggttacctattcgtctacgcgaggacaaggcaagtatcctgatggtgctaagaatacgcgttctacaaagtatcaaattggttcagcacaggattttatgacggcggcgtcagttatgtatctcaaacaagtcggtaagctgaaattaagcgataagttgagtcagtattatccacagattagtcaatctggtaaagtaacgattcggcagctattaaatatgacttctggcttaagcaataccgcaacggcaccagaaacacagagcttttcaaaacttctacagtggaatgtgaagcatgtagataacacggcaataacaggtacatatagttatcaagcggtcaattatgttttattggctggtattatccaaaaagtgagtggtcagtcgtataatgagtttgtccaaactcatttaattagcaagttacatttaaagaattccggttttgctttaaatgatgccaaacgctcccttttggcaaacccttatgccgatgactattctggtgataagaactatgtcacaggaatggaaagacagcaaaatacgaaattgggaccttatcaactatatatgagtgaccaggatctcatgaccacttatctctatatattcaatggaaagtttattaataaaggaaatctcaatagtttaatcgtgcattctaaatcaacgtttgctggtggagtttatcgggataaaattagttttagtgttcacggccaacttggtggttatcaaaacagtatcaagttcagtcgagattttaaaaatggtgtcgtcctactttctaattacgttccaaatgggattaccccaacacaaacatcatcaatcatttataatgcagtttttaattaaaaataattggaggatcatatggatcaaacaagcaacgaagtcgtctcgttcagtgagatattattaacacttcgcaaacacgttaaattaattttaggtacaacagtcattatcaccgcattagccgcgatcgttacgttcttcgtaatgacgcccaaatatagttctggtacccaaattttggtgaaccagaagctagatgctagtatggcgggagctcaattacaaactactcaggctgacattgcgatgattagtacatataaagatattattacaggaccagttattcaaaacacagtcaaaaaagccactaagaatttaccaggggcctctgatagttctgtgagtgttgcaacagaaacaagttctcaagtattcacaattaacgcaacggcaactaatccagatactgcagctgcagtggctaataaaacggcaagtgtatttaagaaaaagatcgtcaaaatgatgagtatcaacaacgtgaccatcgtttctaaagcagtttctaagtcaacaccggtttccccaaggatcaagattaatcttttggcaggcattgtcttaggattgattttaggtgttgcgtttgcctttattagtgaatttaacgataaaacaattaaggacgaggttttcttaactgatgatttagggttaacaagtctcggcattgtgaatgagatgagtcaaaaagatattgaccggcagattaggaaacactcacaaggtgcagcacggtcaaaccatgcacgacgaagggtttaggtgaaaatatgccattatttagaagaaaacgtcaaatcgatagtgaaagcttaaaatatggagttggtttagtttccgtaactgatcctagttctgtagttgctgaacagtttagaactattcggacgaacatccaattttcatcagttgaaaagaaagttcagtctttagtagtcacgtcagctgaaccatcagaaggaaaatcaactgtgagttcaaatcttgccgttgtgtgggcaaaacaaaacgaaaaggttcttttgattgatgctgatctccgtcggccaattgcccatcgcacttttaatcttttgaatgcagccggtttatcaagctatttaagtaataatgcggtctatgaagaaattattcaagaaactgaagttcctaatctgagtgtgattagtagcggtcctataccaccaaatccagccgaattattaaattcacgtcacattaataccttaatagagcgtttgaaagatgagtacgatattatcatttttgatgcaccgcccattaatacggtgactgatgcacaattgttagcaagtaaagctgatggggtcattttggttgtgcctcaaggcatcgctgaaaagggtagtgtgactcacgctgttgagcaattgaataaagtacatgccaaagtgttaggaacggtcatgaatcgatttaaggctgataaagcaccaggatactatggtggttactacggcggcaattatggtggttactacggagtagatgataaaaaatgattgatttacattgccatatcttaccaggtgttgatgatggttcgccagacatggaaacttccttgagacttgctcaagtagctgttgatcaggggattactcacatgttgttaacaccccatcatatggatggacagtatgttaatcacaaagcagcagttatgactaagacggaagcatttcaaaacgcattagataaaagtcaaatcaggttaacggtttttcccggacaagaggttcacattacgggtgagttgttgcaggcaattgaccagaatgatgtgctttttgcagatgaaggtagtcgttatttaattctcgaattaccacataatgaagttcctgaatatactagtaaaatgttatttggattacaatcacgaggcattacccctgttttagttcatccagaacgaaatcaaggatttatgcaggatcctgataaactttatgagtttgtgagtcagggctgtgtgacacaattaactgcaagtagttacgtgggtgtttttggagaacatgttcaaaagtttacggaacaaattattgatgccggcttagggtgcgtgtttgcttcggatgcacataattttaaaggtagaaatttcaaaatgacgcaagcttttgagaaattagaaaaagaaaaaggcgttcgatttgccgaaacttacaaagaaaatgcgaaaagtattatcaatggggatgacgtgatttttggggaaattcaccatgtccaaggtaaaaaacgaaagaaaaagctttggggattattttgagatttagtgtggagttaattaaggagcgggtagaatggaaatgaacaatgtcaatgaaaaatggttggataaggatcaggttcggactcgatatatatatattatggagtaaaacgggtctttgattttgtagcaagttttctagcgctaattgtgcttagtccagtgtttctggttgtggctctatgtattaaatcagaagattggcgaggaccagtgatgtattcacaaattcgtttgggaattgatggtcgtaagttcaaaatgtacaagtttcgttcaatggtggtagacgctgatgcaaaaataaaaaacctactcgataagaacgaagttgatggcgccatgtttaaaatgaaagaagatccccgcatcacaaaggttggtgaatttattcgtaaatacagcttagatgaattaccacagttatataatgtgttgatcggtgatatgagcttagtaggtccacgtccaccattgacacgtgaagtcaaagaatatacagattatgataaacaacgtttgcttgttcaaccgggctgtacagggttatggcaggttagtggtcgtaatgctttaggtttttctgaaatggttgaactcgacttaaattatatcgaacacagtagtgttatgtttgacattatcattttatttaaaacagtaaagattatgattattcctaacgacgcttactaaactaaaggagactcattttggaacgacacgtttttatagttggatctaaaggcattccggcgaactatgggggatatgaaaccttcgttgaatatttaaccaaatatcgaaaaaaatgccgacatacattatcatatagctgaagtgaacccccggtattggaccaaaatccaataccgggggttttactatgaccaaatacaacaaacagtttaaacgacatgttgttcaagactatctgacttcttcattaagttttggcttgatcgccagaaagtaccagatcaaaagtcatgcgaccgttaataaatgggtgcgtcaataccagcgtttcggcgttagtgggcttgaagttcgtcgaccagagaaagtttatgatggtacttttaaggtgaatgttttaaaatggatgaaaacgaatcagacatccataaccgaaaccgccctcaactttgatatttctgcgccgtcaaccgtttggcaatggcaacgaacgtttgaagatgaaggacttgatgccttgtttcgtaaccgaggacggtcaaaaattatgtcagctgataaacaaggcaagcaaaagaaacaaccagatgaattaacacgcttacgtgacgaaaacgaattactaaagatcgagaatgaatacctaaaaaaattgaaggccttggctcaatcacaatcagacaacgagcacaaatcatccaagaactaaggcccaattatcggctcggtaagatccttaaagtcgttggtatggctaagagcacctatagctacgcgataaagtatcgcccaactgaaaatgatccggacgcgatccttaaacaaaccattacggacattaaagctaaagccactgcggccggttatcgtcaagttactgaccaattacgcacaatgggtctggtggtgaatcataagaaagttttgcgcttaatgcgtgaactaaatctgttatcaaaggcatataataagcaaacccgtaagtataattcttataaaggaacagttggggttgtagctaagaatcggcttagacgacgctttatgaccaatcgaccgtatcaaaagttaacgactgatattaccgagcttcgttggggcaataaaacgattaaagaacgagcttactttacgtgtgtttatgatttattttccggtgaagtcctgagccataatatctctttaaatccaactgtggaattcaccactgatgttttaaccacagcgatcaatttgattccaaaacaactaggttatcggacaacggttcactctgaccagggttttcaatatcaaaatccacgttggatccgtattttaaagcaacaacgtattttccagagtatgtcgcgtaaagcaacctgtttagacaatgcagccatggaaagtttttttcacattctaaaagcagaagtttatgaccaaaaacagttcgatacattggcagaattgaccttagtcgtatctaactggattcaatattataattgtactagaaccaaaacaaaactgggtggtaagagcccggtcaaataccgtgttcttaccacccagaaaattgcttaaagtttcgtccaatatttggggttcacttcatgaactcaattcggaattgtttttttaaaagctaaatttttgaactacttacagacaaagttgacttaatttatttttcagcatcagctatggcttgctctttcttaagcaaagtacggtcataatgacgaatgaatgggtaccaaacaagaaaggcaacgaaggcacagaagattgatagaacggcgccttgccaactggcagtggccaagaaaccactcaagcctaccggggttggccaaggttgctgaacaataattttcttgactattccagaagttactgtgaaatagccaacgatgccggatactaatggtgcacagataaatggcactgctaactggacgttgtagacaattggaagtccaaataaaatcggttcgttaatgttgaaaatagctgggaccagttcaaccttaccaatactgctaagctgaacggatttagctctaaaacttaaccaaattgccatacctaaagtagcaccagaaccaccaatgataacgaaggcattcatgggatcaccggcgaaaaagtggttagcaccgtgaacattagcggccatattagccaaaacgattggtgtatagaaagaactcataatggtagcaccatggatcccgaaccaccagagaaggtggatcaagaagatgatgactaggaatccccaccatgtatcagcgatgttactgataaatgaaaatggaatgtaaaggactttaaagatatcggttccggccataatcaaagccaagttgattgcaccaacaacaaaagctacacagaagcctggaattaaagcactaaatgaatttgcaactccggcaggtactgaatctggcattttaatttgccagttgtgtttgatggttaaacgatagatttgaactgttaaccagccaacaactaacccagtaaaaataccaactgaagcaattcgagtgataccgcttgtagaaacggcataaccaccgccgataacgttcaatttatttaaagattgaacgaactgaatgctaccgtttttccaaactaattgaggaacagtaatgaacattgccattaagaacaacattaagccatttaatggatcaaggttaaggctttcttcatcacgataaattttggtgtatgtgtaggtaaaggtcccagaaaaaaccaatgccaaaatacccatagttgaattataaattacttggaacatattggagaatcttccgattgtaccagcataccaagccgcaaatccaggaataggaaaagcctgtggtaaaacagttaaaattaagaaaatagcaccaacaatagaaaaagtgataacactatagccggcagccatgattgctcgtacgaaacgtgagccggagaatataccgatagcattactaaatttgtctttgaatgattctgattggtcagccatattttttcctcctatatataaatgaaaaggttgataaacaaaaatatgaaagtaaaccagaccaatggttaagtagtttttgtttatgccgtttttctgaattgttatgtgataatttaagataccgtaactaaaccaaaatcaaaattggtctatgatagaaactctttaagtactcataaagtaacgtaaaaatgtaagtataatagctgaaatgtttgcaactttttgatttttctaaatggcaaattactcagttttataatgtttttcaattatgttttcatctatttcatctccttgaaatcaattgctaaagactagcttatgttggttagtttaaaatatttgtattctttttgcaagcgctttctaaagcaaatttaattaaaaaaagttattggtataggtaataccccaaatctagggggttttcacttctgtgtggttactgaaattaaattaaaattcctcaaaaaaagtaacaatcgaacgttaaagtgtggttgcttttaactattcatttatttattttatgaaacgctaggaaaattattaattttgaagtgctcaattttgaatagaccgatttaaataaaataatgctttcatccgttatgaatttgaaatttggttgtgcaaatatttcgcattagctaatttgcgctcgttataatgagggttgtaaacgctgttaactcaaacaaggtaaggagaatattctatgacctataaatcagtaaatccctacacgaacgaaacgtttaacgagtatcaaaatgcatcttctaaagagatcgaatctgccttgcagatggctgctgatcttgctcacacgtgggagagtgaatcgcgttccaaacgagcagagattcttcacaccgttgccaatcaattgcgagcacaaaaatccagtatggcggaaattatgactcaagaaatgggtaaattgattggtgaatcagaagaagaagtaagtttgtgtgcgtcaattgccgattattttgcggaccatgcggatgaatttttagaaccaactgagattgaaaccactggcgcgagcgcaaatgttttgaaacaagctttgggaccaattttggcatgtgagccatggaactttccgttatatcaagtcatgcgaatttttgcaccaaactttatggtgggaaacccagtgatcttaaaacatgcatccattgtcccgggatcggctcgaaaaattgcccagattgtggaagaagttggtgcacctgaaggcagtctgatgaatctattcttagattacgaccaaattggcgaaataattgccgatccacggattacaggggttgctttaaccggttctgaacgcggaggtaaggaagttgccaaagcggcgggcgagaatctgaaaaaatcaacgttggagttgggtggtaatgatgccttcatcgttttagaagacgtggataaagacgtattatatgaagttgcaccgacagcgcgtttagccaatactggtcaaacttgtacggcttcaaaacggtttattgtcctcgattcgctgtataatgatttcatcaagcagctaacgaaagctttttcacaagttaaaatgggcgatcccatgaaccgggatacaactttggcgccaatgtcttcagaaaaggcaaagaccaaactacaaaaacaagtggatgaagccgttgcggcgggggcaaccgttgtttatggtaatcagtcggttgatttagatgggcaatttttcatgccaacgattttaactgatattacgtctgaaaacccaatttttgatcaagaattgtttgggccggttgccaccgtttatcgggttcattctgagaaagaagccatcgaattagcgaacaactcacaatatggactgggaagcgtggtcatgtcgagtgacttaaaacatgctgaaaaagtggcaagtcaaatcaaagcgggaatgacgttcgtaaaccatggctggaccagtttaccggaattgccctttggtggcgttcggaactctggttatggacgtgaattgagcaaacaagggatgctgacatttgtgaatgagcatttaatttatacggttgaaaaataacgaaaagagatatcggctaaatgacacgagaagtaattattgctgaatattttcagatgtggatcacaaaggacttttccaagctgacagagtgttttgctccggaaatttgttatacggaatgctatgggcctcagtatgtggggcttgatgaagttcaacaatggattaaaaatgagtcagctaagcaaaccgttttggaatggcagattgatgaaattaaatctgtcgataaccagtcttttgtaaagtggttttttaaggctcacgaacaaacgacttacgaatttgatggagtttctgtgattcagtggaatgcagagggaaaaatttccaaattggatgaataccagtctaaatcggaccatatccgtccttatcaaatcaagtgaaattgagaatccatgttgacatggttattaggctctgtatactcttagatagaaataaaatcgattctaatatagaaaaagaaggagtaaccatggcaaataatgtgacggttgttggtagtttgaatatggatattcacattccggttgcacacatccccttgcagggagaaacactgagtttactaaaacctagcagtcaggcggcgggcggaaaaggtgccaatcaggctgtggctgctcagcgtttaggcgcttccgtgcatttcattggttctgttggtgatgatgacgctggaaaacttttgcgaaataagtgtcaaaatgaaggcattgatattagcggaatccgaattttgaatgacgctaatactggacaggcgtttattatgctggaaccagatggccataacacaattatggttgagggtggcgctaataagttgggttcagtggaagctgttaatgcagatcgggtgaatattcagcgttcacagattacgattgcccaattggagacaaatttggagccggtcatcgcggcgtttagattggccaaacaagtggatcggttaactattttgaatccagcaccggctttgcctgaattaccggaagaattgattcagttgacggatgtgattacgccaaatgaaacggaagcggcgacattgactggtcaaaaggtagaaactgaagcagattgtcaaaaggctgcggcgagattccaagagatgggaattgccaatgtggtgatcacactgggatcaaatggtgttttctacagtgtgaacggtaggagtcgattggtgcctgcgcataaagttacgccggtggatacaacggcggcgggagatacgtttattggtgcgattgcggcaaaggtggtgccagatttgagtaatatggatgagacgattgagtttgcaaatttggcgtcgtcattgacggtgcaaaaagagggcgcgatggattcgattcctgaattaagagaagtgaatgaagtaaagtgaacgaagaagaacgggagtcagaagtttctaagcgtaatggaggcgggatcgcaatcccgcaggaattatgcttaattatttaaacctgatttgcggagttgtcctaggactcggcggaaaaaggataagatgacaacatgaagcaccatgaaatatcaaaaaaagggaagtctcaatgaaactaatagaaacagatcatgtcagattaacagcaacaaaaaagaaatttagttggttagaactagctgcatggatagctttaattgtatctttgagctggttatggaagaagaattaatttacacaaaaaactagaatccaccttactttgattaaggaagattctagtttttaattggcacaaattaagtacgtgcccgaaattgatggcgacatgtcggacaggtaatttgaatttttccttttcctttagggatgcgaatgcgttggtgacagtttttacaggtgaaaaagcgatattgtttgcgttgctgccattcctgataacggcgacttatcggtttagttaaccaagctgtccattgctgaaattttccgttttctcgagctcgttggtagatttttcgtgaaaacacgcgccaataagtagcgatcagaaaaagcaggcccaacagattgagccaaccagcgtggataaagatggttaagaaaattaggatcaaaccacaactaatcaaaaatttattcaaactgtccatgattccgtaacggccctgcatgaactgtacgaccttataaagccattttggtggttgtttcaatactatttcacctcacttttgcttaataacaattgattgaaaactaaacatggcatgaagcacttagacaatgagttctcatgtcatgtttaacatcatacaacaatctcgccttaatattcacctgtcttatggtttaagggtcatttttataaaggttatcggcataccaaatggtttagcagcgcgttcgctgacctttttgaaacccattttgttataaaggtgaatggcgcgttcattaaaatccgccacttccaaggtgactttgccaaagtagtggtagtgctgacgaccaaaggcaatgcattgttgaacaaattgttctccgtagccttttccagtatcttcagggcgaattccgaagccgatttccatgacgccattgtgaaactgatattcgtaaattccgaataattgctcattttcatctaagattgaaaagtaatcgctattactcatcagcaattcgtttaataactcagagcgactaactgaaggtggaaaattataaaatgtatacggttctggatactgccaattgaggtaagtatttgcttgttgcgcattcattttcataattctggccatcatggacacttcctctcacttttaccaccatcatacgctaaaacacctttgtttcatagcgatgacgggtatctaccttattttttcttctgaccgatcacaatggttaggccaattaaagctgcacctaaaataaggcagagcgtattgaatatttgaggtgagaatggccgaataattccgataacaagaatcaaaacggctactgccaataagcgttgataaaatttgtttgacattgaaaaacttcctttttttaaatgggtggttctactattctatatgcgagcatttttataccagcggggcaaatgatacagaataaaatgtttagattaaggtatcaatgatatgctatgataaatatatcatagtggatctatgtgaattgaaaaatgatcgttatttttatgagtcttgttggctacattgagtagtcaaacttgaggcagttcttttatataagaactgcctttttaatcatcataaattataaactcatgatagttatttttataggaaatattgtttttttaaaataaccgtgtataatacaagtatagtaagataagaaaacgttatcaagtaattctaattctacagtgaaatggaggaaaaaacatgccggataatttattagagtatgagatgtggggcaaaaatgcattatactgcgagccgcttagtcgtggctcagaaaaaatgtcatttccgctccctacttatcaatctttgatcggaacttccgaaagtatttactggaagccaacttttaagtatgttattgatgatctgagggttataaatccgattaaagtcgaatcgaaatcaatgcggccattagataaaagacttgcactaaatcataatacgttagccttttacacctatttatctgatgttaggtatcaagtacgctgccatattgagtggaatttgcagagagaagacttggtcgctgatcgaaatataaagaagcatactgcaatttttaaacgagcacttaaggctggaggacgcagagatgtgtttcttggaacacgtgaatgccagggatatgttaaaccacaaatttttggttccggtgctggttattatgatgatgtggaatctcaatacttcggattaatgtttcatggctataactatccatctgatacaggggatccaatgctttctgtgagaatggatgcaccaataatgaaaaagggagttgtccattttaaaagaccagaagagtgtaagattattcagccaattcgaaaaattaaagacactggtggccatgaccaaaaattatttgaatcggtagatgacctttataagcaaatgattagaggcgatgataaatgaccgtatttcaggatttggttaaagtctatgatgataatcaagatatgattggtaaatttgagcaagaccaattcaaaaatgattatactttattgccagcttcacatgtttccgtgagagttcaaattgaggtcactttgaataaagatggacagttttatactgcaagacaattagataaaccgggtgaaacgactgtgattcctgcaacaattcattctgctaatcgagcaagtaatatagcagcacatccgctccaagataaaatcaaatatgtcgcgggcgattactctgaatacgcaactaatgataaaaaagctaaggcatatcacgaagactatcaagacatttttgggcaatgggtacaatcgaaattttcaaatgcacgattaatagccattgaaaaatatcaagaaaaaaattctttgataaaggatcttatttcggccggggtcgttaccctagattcagggaagttaaccagtaaggatagagatgcttatgtacgttttgatgtgtatgatgacaatccagaatcaatatggcgagatacagagatgtatcagtcgtggacaaaattttacggtcaattgttaaaagaaaaaacaccactaaatatcgattatttgactggaaaattagttccaacaaccaaattaattgaaaaaaatattaatccagccacaagtggtgcaaaattgatttctgccaatgattctagcaatttcacctatcgcggaatgttcttgcgagatgatttttatagtattggctatttggaatcccaaaaaatgactcatgcgctaaaatggttaattcaacgacaagctttaaagagcgatagtcgtgtgtatctgttttggagtgaaggtaatagtaatgattccgttgcacaaactgcaaaatctctcacaagtggcataacagattggcagactcaaaaatatcaattgctttcacagagtaaaggccagggagatactggacaacaaatatcccacgcctataactcacgattgttgggtcttacttcggatattgagtatggaaaactagttcatataatttttcttgatgccgcgacgactggaagaatggcaactgtgtactataactttatggatactaaaatttttaaggaaaatatcgagcattgggcaaaaaattgtggagtaattattaatgacggcggtggccaacatattcatacgccaactattaatcagcttattagcagtgcgtataaagtaggtcgaggcggtcaacgttacgaaacattaaaaaaacatgcattaggagaaatgatagttgccatcacaactggccagtcaatatctcgtgatttgctaaccgtaatacaacaccgactggctaaaccacaagggtatgatgcattacatcaatggtataacgatttatataattttgctgcggcctttaattacaaccaaaagggaggaaaaaagaatatggctttaaatatagataatcacgatcgatcatacttatttggtcggttactagcacttgcaaatgacatggaagagcgtgtgttgtatcaacgccaatccgccaattctaatgtaagttcgcgattgacaacggccttacgttttatgactaatttttcaaatcagccagcgacaacctggaaaagaattaatgaaagcatcgtgcagtcctactttgggtcgttgagtgctggaagtcagcattattatttaggtcaagttactgacattttggatttgctagaagatcatgggatgacagatgaaccactaacacctcaatatctgaccggatttgcatcacaatatgtttataatcataaaaaacaagacaaaaagacaagtctacaaacggaggcgtaaaaatgagttcaaatattttggaacataaaattgatttttcagttgttatcggtgttaaaaatgccaatcctaatggtgatccactggatggcaatcggccacgagtgaacgcggatggttttggcgaaattacagatgttgcaattaagcgtaagattcgtaaccgttggcaagacatgcataaaccagttttggtgttaatggaagaaagagtcaaagatggtgtgatgaacattcgagatcgtgtgaagcagagtgaggctgttagggatgctattgctttacaaaaagatgataaaagtcattggcgcgatgctttttataatgcggcctgtgcaagctggctagatgtacgtgcttttggacaggtaatgccatttagtgcaagcaaaaaattaaaagatggtctggatggggtatcgattggtattcgtggaccagtttccattcaatctgcatacagtgttaacccaattaatattaaagaagagcaaattacaaagtctattaatctcgaacctggtagtgaaggtaaggctagtgatacgatgggaaccaaggcttctgtgccatttgcagcatataaatttaatggcagtattaatgttgagcaagcagagaagactggttttacggaagatgatgcagcggatctgaaagaagctttgaaaacgttatttgttaatgatagttctgctgcacgtccggaaggctctatggcagtcttaaagctggtttggtgggaacatggttccaagttgggaaaatttgcaccctacattatgcatgatttgacaactgttgaagttccagaaaaagcgcaaaactttaatgaaattaagataaccgttaacgatccttcagacacgactggaattcataagacagttactgatggctattaaacattttgacgggagttggcaaaatgtatattgcacatattagtgaagatgatgaacgtatacaatcgttaaaagaccatttgttgaatgtgagggctctttgtgaacaatggggaagtaaaatcgggctccaatatgtttgtggattagctggttggcttcatgatgcaggcaaatatagccaaaaattccaaaagtatattcgtgatccgaatggaaagcgggggtcagttgatcatgctactgctggggccattcttttgtatgatttttctcgtggcgaccaacatgatttcaaccaagaatttagtcccaagaaggatggctctgaggcgttaatagaagagctattagggaacgtcattatggcacaccataattccaaaggtgctcttgattttattgatccagtgattctgaatatgccctttacccaacggttaaataaacaagttaaaggtattcggggatatgatgctaactatcaggaacaataccaacaagtggtgaataactattttaccgaatttgaggaagaagaattcgcagattactactcgaaagccctatcagaaataaaacaaataggaaataaagtacttataaatgatcaaaacttttatttgaggtatgtgctgagtgtattaattgatgcagatcatactgatactgctaattttgaagggaataccaaatttgggtatgaaaataatcaacatgatattctcaatcaatattttgatgtgaacgaaaaggctgttcaaacccaaatttgcgaaaatacaaaagaaaaaaataacaaaacaaaaaaacttaattggctgcgtcaagaaatgtcggatgcttgttttacggcggctggtgagcaaacgggcatttattcactttctgttcctacaggtggaggtaaaacactttctagtttacggtttgcactgcgaaaagctcaattacaaaatgtagatagaattatctacgttgtcccttacacgacgattattgaacaaaatgctaacgtcattcgtaaccgtttgaatggcagttcaaacaagacggacaacatcttagagtatcattcaactgttacacaagagccaaagaaagatagttactattattcttgggacagttgggattctcccattattttaacttcccaagtagcttacttgaatgccttgtttggaaaaggaagcaaaaacatcagacatatgcatcaattagtgcatgctgttgtgatattcgatgaaattcaaacattgccgattaagtgtattgagatgaacaatgccgccttaaaatggttgaaaatacaagggacgactagtttattgtgtacagcaactcaacctgcgttggacaaaattagaaatgggttacctataagtaaagaaattgtgcctgatttaaaattagcacaacaagcattcaagcgtgttactattcgaccagtattcaacagtgataaacagttaaaagtgttttccctggaagatttaacagaatttatagacgataaattacaacagggtgttcatagcttattggttattttaaatacaaaagcagccgtacgaaatgcatacgaagcgttgaacgatcaaaaggacctatttaaatatcacctgtcaacagccatgtgttcaaaacatcggcaggttaagttctctgaaattaaaaagcaacttgaaaatccgcaaaaaaattcaaagaaggttgttgttttttcaacaaacctaattgaagctggtgtggatttaagctttgaatgtgttattcgttcttgtgcaggtcttgatagcgttgtgcaagctgcaggtcgttgtaaccgcaacaacgaagtgaaacttggttatacttatttgatacagatggataaaaatgtggaaaatgttggcgggccgctaaaattcttaggagaagcagccggcattacaaaggttttattagctaataatgttaaccgagatcttttatcggatgaaattatgagagattactttatacgtttgtatgctaaaaggagttctgatcttccttatccaagtgataatggattaaaactttatccattaatcggcagtagtgatgaggataaagagcccaatgttagtagcgagatcagttattatcagaaaaacaaaaaaataccatcgacttatttaagtgtggcaccaaatacagttgcgaaattgtttcaagtaatcgattcatcaacaactgatgtgattgttcagtatggtgaagggaaaaagctcgtagctgagcttatttcccaaaaaagcaaatttgaaagtatttcaggacttttaaagcaagttcagaaatattgtgtttcggtgtatgggaatcgggaagaacctggtagttatctaggtaaattaatggcggatggcagtgtacgctattgccaagaacaagatatttttattgctgaagatggatcgtatagtgaagaatttggtttaggcgaaggaaaatttgattctttagactactaatgcacttagttagtattgtggtgcgagtatgaagtgcacataaatgtgctaggcagttcgcaccaatatttgcaggaaatgatttatttttagttgtatttgttcgttacatttttttaattatgtccagccgtctaaatatagatatttcttcaccagatatactatattttgcggtcgcatcctttatgggtgcgtgaattgaaatttcatgcttattcctcctaaagcaatttttctagtcgcatcctttatgggtgcgtgaattgaaatcatgctccattagtccaaacataaagttcctcattgtcgcatcctttatgggtgcgtgaattgaaataacaagttaatggtggtgaggctacagagaaaacgtcgcatcctttatgggtgcgtgaattgaaattctaattcatacgtattaacatgtcgaccgcttggtcgcatcctttatgggtgcgtgaattgaaataataaaagtagtccctgaatattcgggggctatttgtcgcatcctttatgggtgcgtgaattgaaattgtagaatattccacagagaaaaatgctcacacaggtcgcatcctttatgggtgcgtgaattgaaatatgttggtgattagcacgttttctagctgatacgtgtcgcatcctttatgggtgcgtgaattgaaatccttagcatagccaggtaatgtatggcctagcccacgtcgcatcctttatgggtgcgtgaattgaaatcgatatttctgccatttgattaacataagaaataccagtcgcatcctttatgggtgcgtgaattgaaataaagaacctcctagtgatacaatggctgcttgtattgtcgcatcctttatgggtgcgtgaattgaaatacaattaggataactgtttgagagagcctaagggcgtcgcatcctttatgggtgcgtgaattgaaatatatatgcattactgttgccttcattgttattagcggtcgcatcctttatgggtgcgtgaattgaaatactatgacaatattaatgattatttccatgagtgtcgcatcctttatgggtgcgtgaattgaaatacgttatctaaatttagaaagtgaggtgaatatatgtcgcatcctttatgggtgcgtgaattgaaatatttaaaatcaaaagcagtttcaaaaaagggcgcgtcgcatcctttatgggtgcgtgaattgaaattatccaaatgcaaaatatcacgcaatttgtgaaagtcgcatcctttatgggtgcgtgaattgaaattaataattgtatttgtcatgattaattaactcccttgtcgcatcctttatgggtgcgtgaattgaaataaaagccatcaattaatgaatcagatttaggatttaaagtcgcatcctttatgggtgcgtgaattgaaatagaccaatacggtagaaaaaccaccaacaattgagtcgcatcctttatgggtgcgtgaattgaaatatattttggctgtggattggctaactcatctgcatcgtcgcatcctttatgggtgcgtgaattgaaatcacaatattcaaattcatatttcttcaattcttagtcgcatcctttatgggtgcgtgaattgaaatatacgcccgaccataacgtgtcatatccaaaaacgtcgcatcctttatgggtgcgtgaattgaaatacacgaaagaagacggttggttgccatgggtacacgtcgcatcctttatgggtgcgtgaattgaaatacgattgcaagtatgaattataaagaaaggttaggtcgcatcctttatgggtgcgtgaattgaaatattaatagaatcattggtatagtctcctgtgcttgtcgcatcctttatgggtgcgtgaattgaaattttatcacgatcatatagattgtaatcatgctgattgtcgcatcctttatgggtgcgtgaattgaaattggatgaaatgaatagaagacaaagtaaaggcgattgtcgcatcctttatgggtgcgtgaattgaaatttcaaaacggtaatagaatttcgcggattacttgtcgcatcctttatgggtgcgtgaattgaaatatcgaatacgcaaacgaattaatcgagaaagatatggtcgcatcctttatgggtgcgtgaattgaaatgtttgacaaattcttttcgaccatctgccgtggtcaagtcgcatcctttatgggtgcgtgaattgaaatcaacagttgctgcattgtttttttgacgttctagtcgcatcctttatgggtgcgtgaattgaaatctaaaaaagacttgggtgtggaccttgtagcccggtcgcatcctttatgggtgcgtgaattgaaatactttgatccatctgacacaagcgtatggactagtcgcatcctttatgggtgcgtgaattgaaatatgcgagttatcgcatggttgatcagaccagttgtcgcatcctttatgggtgcgtgaattgaaatcaaccgtgaagaagcactaagttctctggttctaggtcgcatcctttatgggtgcgtgaattgaaattgtctgagtgaagaaatacaccaatcccgttaccagtcgcatcctttatgggtgcgtgaattgaaatccaagtaacgggcttacaaaactagatgatgaaggtcgcatcctttatgggtgcgtgaattgaaatatcgctcccttgtgggtatacaatattaatctgaagtcgcatcctttatgggtgcgtgaattgaaatagcgatctttgaatctgatagtcccatggtaacggtcgcatcctttatgggtgcgtgaattgaaatagcagaactgtacagcttattggcacggaacatagtcgcatcctttatgggtgcgtgaattgaaattatcggacaaggcaatggttacatctaaggcaacgtcgcatcctttatgggtgcgtgaattgaaatactgataccacccagactaagcggttaatcttacagtcgcatcctttatgggtgcgtgaattgaaatgataatgactgcattataaattacactctcacccgtcgcatcctttatgggtgcgtgaattgaaatcggtgcatctactgattgtagaaaataccaaacagtcgcatcctttatgggtgcgtgaattgaaatgggtggactggaatcattccatcggcatcgtttagtcgcatcctttatgggtgcgtgaattgaaatctattggggaatattggaatcagtaaatatatttcgtgtcgcatcctttatgggtgcgtgaattgaaattaaatacggcttcatattatcgtaactgttgatcccgtcgcatcctttatgggtgcgtgaattgaaataacactaacagcaagctgttccgctttagcaaaaagtcgcatcctttatgggtgcgtgaattgaaattgtatgcacattggtcagatgatattcattatttagcgtcgcatcctttatgggtgcgtgaattgaaatacctgcaagagtggcaagcgtttatcttagcgtcacgtcgcatcctttatgggtgcgtgaattgaaatgtcactaggagttttagaatcacaatgttttgcacgtcgcatcctttatgggtgcgtgaattgaaataggtgcccacacaccaggttctggctggtctgttagttgcatcctttatggccgtgtgaaagcgaaatcaacattattactgatgataatattagtgacttatcatattatttcagtttattgaccatacacgaatgaatcatttagaagctaaccatacaatatctttgaataaagcgtttacatttttagaatcgatgatattatgatgttagagaaacactaaaacgtgatggtggagatgaaagaagtggaatattcggaagatgattttttgatgatatccggtatacaacattttcgtttttgtcagcgacagtggtcgttaatccatgttgaacaagcatggcaggataatctattgacctatgatgggcaaattctacatacaaaagctgatcaacctgaaattcgggaaaaaagaaaaaataagttgattgtgcgatctttaccagttcattctcgtgaattaggtttaacgggtatttgtgatgttgttgaatttgaggagaagcctgatggcgtgtcgatctttggcagtgagaaaaagtacttgcccaaaccagtagagtataaacatggacataaaaagtatgatttgtcagatactttacagttattagctgaagcagcttgcttggaagaaatgcttggatgtacgatccgttctggtagtattttttatcaacagactagacgacgtgaagaaatagaatttactgaatctatgcgtgaacaattacttaatacaacggaaaaaatgcatcaatactggaaaaaacgatttacaccaagagtcaaaactgggccatggtgtaaaagttgttcattagctaatatctgtttgccagaattattatctaagcagaccgttcgtagttatctaaaacggaggttgagtgattgagaaagttattaaatacactttttataacgtcacctgatgcctacttatctttggatggtggcaatatagagatacgggcaaataagcaaattttaggtaaggttcctttgcttaacttggaaggaatagtaacgtttgggcgtgcaggagctagtccggctttaatgaatgagtgcatgaaaagcacgattccaatgactttcttgtcaccaagtggtagcttgatgggaagagtaattggggtgaccaacggaaatgttgtgttgcggaaaaagcaatatcagatttctgaggataatcaagagagcggtctgatagcacgaaattttattatcggaaaaatctataatcaacgttggatgttggaacgagctacaagagatcattcattggtaataaatacaaagcagttcaaattagtgtcaggtcaattgcaaaaggttacccaacagctatcatctgcaacagatattgatataattcgaggaattgaaggaaacgcagccacccagtattatggattattcgatcaattaatcttgcaacagaaaaaagattttcagtttcatggtcgtaatcgacgaccgccattggataaagtgaatgcgttactttcttttgcatatacactattagcgcatgatgtttcagctgcattggaaacagtgggtttagattcttacgttggattcatgcatcaagacagacctggacggatgtcattagctttggatttgatggaagaactgcgtggcgtatatgccgacagatttgttttaagattaattaataaaaaaatcgtgaattcaaaagattttcaaaaaaaggaaaatggcgctgtcttattacatgaggatggcaggaaaaaattcattgaagaatggcaacaacgaaaacaagataagattgtccatccttacttgaacgaaaaaatagcttgggggttagttccttatacccaagctatgctactagcacgttttttacgtggggatttggatgaatatccgccgtttctttggaagtaggtgaattatgttaattgtagcagcatatgatattgccattacttcggattgcggaacacgtcgattaaaccgtgtgtcaaaaacctgtacaagatatggacaaagagtacaaaattccgtttttgaatgtttaattgacgatatggaatttttaaaaatgcgccaagaattaacgaatattattgatccaagccaggatagtcttcgcttttatatcttgggaaatcactatgagcataaagttattcacattggcacaaaagatgtacaaaatttagacggaccattaattatgtaattttatgttaaatttgaatgtttctttgtagtttaaaagccttgttaagcgactaacagaaagaaaacgcgtaaaatttaatgtgaaaagcaattaattttaagaaataagggtaaatcatgtcagttttaacagatacatttgaattagcaaatggcgtcaagattcctaaagtaggattcggtacttggcaaactccagctggggacgtagcttatcaagctgtgttaaacgcattgaaagtgggttatcgccatgttgatactgccaaagcatacggtaacgaagccgatgtgggtcgtgccgtgcgggattcaggcattccacgtgatcaggtctttgtgacctcaaaactacctgctcagagtaaaacatacgatgaagcaatggccgattttgatagtacatttaaaaaattggatatcgattatgtcgacctatacttagtgcatgcgccatggccatggaatcagatcggtaaagattgtgatgagggtaatattgaagtttggcgtgctatgcaggatatttatgccagcggtcgggtaaaagcgattggcgtttctaattttaatgttcacgatcttaaaaatgtgttcgctaacgctaaggtaaagccgatgatcaaccaaattcagtattacgttggttatacagaacccaagatcacgagttttgccaaagaaaatggcgttttagtggaagcttattccccattggcaactggtgggttgttgaaaaacgatcaaatggtggctttagccggtaaatataacgtgagtgttgcccagatggcattacgtttctgcttgcaaaatggtgttttgccattaccaaaggcagttggggaagaccatattgaaaacaacgctaagctcgattttgaaattagcgatgcagatatggcaactttgaataatatgccagatacagccccagaacattcacataattccacacaaggttaaaattaaattaaaaaactgttgactttctaattatgcaattgcataatgattgtaattcagagcgagggaggcgacatagatgcagaattcaaaattaggtttaaacagtattgtgattagtgtgattaagatgactgccgatgtgtcgtccttcttaacttgctagtttagtttgagttagacaattttggaccatcggttaggtaaaatacctagcgggtggtctttttttataatcagaaaataggtggaggttcttatatgaaaaatggtacacatcttttaacactcgataacggctatcatttgtttacacgtacggttggagagggcaaaattaatcttttatgtttgcatggtggccctggtggcacccatgaagaattcgaacattttgacgaacatttgaaagattttggggttcgcgtttcaatgtacgaccaactaggctcttatttttcagaccagccggatttcacagatcctaaggtgcgagataagtatctaacgtttgattattacattgatgagattgaagaggttcggcaaaaaataggtttggacaacttttatttgttgggtcattcgtggggcggcttgattgcgcaagaatatgctttgaaatatgggcagcatctcaaagggttaatcattatgagtatgattgataatattgcggaatatacgccacacgtgaataaactgcgacgtgagactctgacaccagcgcaggtttcgtacatggaagggattgagtcagcggaaaaatttgatgatcctgagtatcaatctttagtgcgaattttggataataatttttcgatgcgaaatccggaagcaagaaagcacaggagtggcggccatttggcgacggcagtttataactattttcaaggcaataatgaatttgtgatggttggaaaactgaatggatgggatgtgcgtgatcgtttgcatgaaattaaggttccgactctgttgacgtttggtgatcatgatacgatgccgcttgacgcgggacgacggatgcaacagacgttgccgaatgcacggtttgtattgacgccggatagtggacattcgcatagtcgagataatccggcggcatttttccagaatttgagtacgtatttgagagatgtggaagaggatagttttacagcgtattaaggaaagtgggcggattgtggctgtcgcaagaagctgtcctaataaaaattgatccaagtcctaaaaaaacgcgatcgagaagccaccacttctcaatcgcgttttaattataatttcacgtccaaaacttttacctgataatcagcatttggtgcttgaactgtcacgatatcacctagggtcttgcccatcagaacagagccaagcggcgaatccagtgaaactttatttgttttaatatcggcctcttgtttacccacaatttgataggttacttgatcgtggtcgtccacaaattcaatggaaacgtacttaccaatttctacaatctgattgtcagtgggggtgacgatctttgagtattgtaattgtttggttagaaaatggagccggctttcaagatggcgtaaatcccgttttgcagaggtgtactcggcgttttcggatcggtcaccgagggcactggcttcggctaaatgtttaatcaaggttggccgttttgctttccaatcttcaatttctttttcaatctggtgatatccagcggcagtaattttattaaagtatggttctaacatagttttcctcttcaatggcttgattttgcctccattttacaccgttaaacaaagagatgccattttgaaaactagagtttaattacagtccgaacgccacttggaactggtttttgccagtcaatctgagtagcagcttcttctaaagaaattgttttgacatctgatttaattttgccggagttgatcaaatcccaaacagccttataaactgcatgttggttggccatgactttaggtgtttgcataccaataatttgaaggccagaagtccgaattgccttcgaaggtaaactgatttctggtccagcaatggagccaattgaaactagcgtagtggcgcgtttcatagctaaactatttggaataatcgcgtgtaaaatgagttcgattggatgaccccataagtaatcgaggataatcaagttacctttaacagataagttatcgagattttgcatgattgttttatcatcatcagccagtgaaatggtttgagtggcacctaaagcttttaggcctgctaatcgttctggattacgaccagttccgataatttcactagcaccaaggtttttggcaacctgaatggctaattgccccgcaaacccagtcgcaccgttgatcaaaacggtgtccccgggttgcatatccaaactaaatttaagtggggcaacactggttaaaagtgaagacgcagcggcagtacttgaataaagatcagtattttcgggaatttccaataataatttggagttggcgactgttcgttgggcatatgagccaaattgcggctttaaagttcgtgccggaaaagcaaccagcttaccgttatcgacgcggcgtccaatgccactagcaccggggatgcttggaaatgcgggatgccaataagtgcttgaatagtggcgaccagcggcgttggctttatcgaagttttcgatcggagcagccaatacgtcaatcaaggtatcaaacgtttcatcagttgtgggttcaggaacatcctgtgaaaaaaaaggagcagttttaaaatttttaatcgttaattctttcataaataatcagtccttttctttttatattactagtaatgtatttaatataaacccgaaaattcttgctgtcaactataaattactggtaatatataagcagaaggtgaaaacaatgaatgaatcacaatttaaagaaatagatgctttgttgcacaaaattggttcaaaagaaacacataatcagcatgaaacgtgggttgctaaacatgcggccattgatggtgatccgaaaaaaaatcatttgacgcataatgatttggatatcttggatgttttgttagacggtgaaaaaacggtgagtgaggttgtggccgccattcaaatcacacaaggtggcacgtcgcgcagaatcaatcatttggaaaaattggagttgttggaaaaattccatcaagcggtaaataaaaaaacggtatatttaaaactgactccatccgggcgaaaattagcacaagcccatatgcagttacacaaacagctgcgagaagaagctcttgcagctgttgcggatttttcggatgcagatattcaaacggtgaaaaactttttgaaccggttgatcaaagctcaggaagattttcaatccgagggttagttaggcattcatcggaagtaaccagtcagaatcaattaattgatgtaaggatttgttgattggcagccataatttggctttgatgatatcttttagggatgtccaaaaaagaggatcatctcgttgagtctgagtgggatagacgaaaaggcattcaccagaaatcgttttaacttcaatttttgcttggtaaatacctagcacttgaacttctaagactgatagattctgattattcaataacatattcatcgctcctcgtattatatattttgaaactttgtttcttactcttcactacttagatgctgcgtgatattctctaattgttcattggatttaggtccaacttattgtcagtaatgggtattttgcgatcgcaaaatcttatctccaaaaggatgtccagcgaactatatcgacattcgattggttcgaatggctcctttgaattaatatactaagtatgcggtggctagattaaaccgaacttaaaaatgtgtgaactttctgcgggcttttggataagaaaatctaaaggccttaattgaatgccaacaaccactaaacaaaggttaaatttaggcacataaataggcttgagtcgcgaattgacgcgatctaagcctatttaaatatctttatgcccgactaaggatactaattcgttttctttcaataatatgaggtttagcggcgtgataaaactcgtttaaccagaaaccttcttttaaatctagcttactatctagtacataaatatccagccagtaatcatgtgttttgtccggcggggtcggtccgatgtaatgctgggtagttaaaggatctgtttcaccaattaaaggaccagccgtactgttatttccttgaatcatctggatgccgcccttttgactggcattctcgggaatttctacggtggatgctgcaggaatatttgcggctatccagtgaatccaagcaaacccacaaacgggcacagagtcgaaatccaaaagggttagcgcaattgttttggcttctttagggatgtccgtaatttcaatcggaaaagagattgccgggtttttattatagatggcctctttgggcgcatatttaccatatttatcgagtaataaaccatttgatgtcggtactgaaacttgcatagtcatgaacctcctcgtgtttatttaacttaaccttacgtcaaactacgcaaaataggaacgaaaaagcttattaattgcgtttcaaaatacgtttccaaattttctgatcagaatagtccaaaacgtgatttgcatacaagcgggtcgtaaaccaagtgacgagcacaatcgaaaccgctaaaataaccaaactaattatggcatccatgattgtggcattgccgaccgcataccgcactggcatgatgctttgggacagaaacggaataaatgagccgattttaatcaaaacggtgttagaattcatggccacaaacgaagctccgtatgcagctaagccaaccatagtcagtggagaaactgcctggctgacttgatctgatcgggaaactagcgcgcctaaaccggctgccaaaatggtgtataacgtgattcccaaaataaagaacaacactaatatgatgataatgttgggttgaacatggctcaaatctagatcttttaagaattgcacattaccactcagatacttcaggccaaacacaccacagattgcggtaactaaaacttgtaacagaatgagaacaaacatgccagtgactttagcaaaaaactgaatttgcggtgagacgctactaaccagaatttccatgattcgggaacctttttccgtagccacttcttgggcaatcagactcgcatagctgaccatgaaaatataaattagaatggtcaccaccatggctaaaatgctgttgacagcctgttgattatctttttgagccgtttcttttccatttgtatacgaaacagactgagttttaaagttggcgggggcaaagaggcttgctagctgtttagcagataatcctaattgggccgccgtttgttgcattttcagtgaatttaatgaattctgtaaactggtggtatctaccgtttttccattcgtccgtgatttatagattgcagaaacctgaccacctttgactgtgacggttaaatagccgtccaatttttcctttgctaaattggtttcagccgccttttttgtggtgattgatttgctgacgttatatgctttcttggtattgcttttaagcaaagccgaacgtaatggcgcgttgttgctcacaatggcaatttgtggtgtttcactagtgtgattcttgatggcggcgatgccaactatggttcctaataaaataacgggcattaataacaaaacgatgtaagtgggacttttaatgtttttgcgaatgacttgtttgcaaacgaccccaaatttattcattagacacacccgctttcattcggaaaatttcatcaagagatggtggctgctgcgaaaactcacgaatgtatccatttttagttgcctgcgcaaagaccgttttaccgacttcaggattggctagttgcaattcgaagccagcttgatacttcttaacgttagtcacgccgtcaattgccaagaggtcggtttcggtgagaggagattgaagaaaaatacgcgtgtcaccaaaactttctcgaatttcattggttacgccatttaaaactgtttcgccttggcggagcatcaaaagtttatcgctaattttttcaacgttccccatatcatgtgaagaaaagataatagcggaaccttgtgctttgagccgttcgataccgtcttcgagaagactggcattcaccggatcgagaccactaaatggttcatctaagatgaccagtttgggatcatgaatgagcgtagcaattagctgcaccttttgctggtttcctttagataaatctttaattttgtcggtgcgtttacctttgacggcaaaacgttgcatccaatcatttagtttttgtttagtcacagctggtttttgaccgcgcaactctgcaaaatagatgacttgttcttcgacagtcattttaagatataaaccgcgttcttcgggcaagaaaccaacgatgtcttgatccttacgagagaaaggatgaccgttccaaaatacagaacctgaatcgggtttgagcaagtccagaatcatacgaaatgtggtggttttaccagcgccattttgaccaatcaaaccaagaatttcaccgtcattaacggtgaaactttcatcgacaacggcctgcatttggccgaacgatttgtttaagtttttcacttgtaacataggtcacaactcccttgttggtgactgtattcgtttacatttattatacaggatattggctggaaaaagaatgtttttagtaggataaggtagaagttaaaaagtttcttgaaaggtatgtgaaagcgctataagaaagggtattatataatcatagtaacagtgaagtaataagtaggagtgaaaattatggaaaataagaaatatagtatcggcctagatatcggaaccagttcaattggttttgcagtcgtggatgaaaataaccgtgtcatgcgtgtgaaagggaaaaatgcaattggtgtgcgtttattttctgaagggcaaccagctgcgaatcgacgtagtttcagaacaacacgccgtcgcttaagtcgccgtcgttggcgtttacgattattgcgggagatttttgaaccgtacataaatcctgtggatgaagcattctttatgcgattgaaagaatcaaatttgtcaccgaaggatgctaacaagcactactcaggagatattttgtttaacgatcaatcggatcaaaaattttatgaaatgctcctatgtcaataaatggcacatctttttctaaacactcgttctaattctgtcggaattaaaccaactgacatcccgaccattaacactgccaaacgccacccgaccagcaagtcgctctaaatcatagaccttaaccaattcatcttgaaggttgcttctttcaaagtaatggtctaacaattcagccactttgatttgacgatcctcaatttgctttttttgaatcaaaggtcgatcaagccactgctttaaaagcctacctcccatcgccgttcgtgtttcatccagtagccataaaagcgtaccttgttttttaccggaacgaattgaacgggtcaattccaaattatatttagaatagtgatccattctcaaataataagaaggctcataggcgaccgccttttgtaaatgcgccaggctccgcttctgcgtcactgtaatatacgtgagcaacgtttcaacggtacttttctcaagcttttcagtcagactttgcgtcaaataactaagttcagctttaacttcaattttattttgatgcgataccataatattcagttttttaaatgaatcttgaatacgttcatcaattgactggtctaccacaatttctttagatcgcagatttactacttcgtttataactgcttcgagggaatccaaatgacttgtttttaattcacccgtcgataaatcagtataagcaaaaccaaacagtttggtatcatcagtggtcagagcggtcaaatagttattggatttggcttcgttcacattggagtccgtaactgttccaggtgtgatcaattgaatcacttctcgcttgaccataccttttgctaaacgaggatcttccatctgctcgcaaatagcaaccttatagcccttttcaattaaaatatccacgtaattttgaacagcatggtgtggcattccacacatcggaatgggatcagtagcattatgacttctcgaagtcagcgtgagttccaaaatttgggcccctttaatcgcatcatcatagaagagttcataaaaatcgccaatcctgtaaaacagaaaggcatccggataatcttttttaatcgccatatattgttgcatcattggcgtatcactagttttttgtggcaaactctctcctactttctacttcacgatcatttcacatttaaattagaaaactttatgttccattttaacattttaattttagagttcctactcttcaaaacggacttttctcattctcgcaagttcaggtgattaatttttgaaaacgaaaacaaaaaagtctggaaacttttgcgttccaaactttttaaaattaaatttattttgcatagttcactgcgcgtacttctcgaattacggtgaccttaacttttcctgaatattctagctgtttttcaatggcactgcgaatatcatgtgtcaaagtagttgcttgtaagtcagaaaccttagaaggctttacaatcacgcgaatctctcgacctgcttgaattgcataactcttcttgacccctttaaaactattagccagattttccaatttttcaagtcgatgaatataattctcaagagaatcacttcgtgcacctggtcgtgctgcggaaatagaatctgcagctgcaaccaatactgaagttacgtattctgctcccacatcaccatgatgagaagcaattgcgttgataactactgggctctctttatacttctttgcaaattcaacaccgattgccacatgagaaccctcaacctcatgatcaaccgctttaccaatatcgtgtaataatcctgcgcgtttagctaacgtaacatcctcacctaattcagccgctaatataccagttaatttagcaacctcaacggaatgatccaaaacattctgcccataacttgttctgaacttcaatctaccgactaatttaatcaattcaggattcatggaatgaattccaagatcaaaaatagtttgctcaccaacttcacggatcttatcatccatgtccttgcgagccttttcaaccatttcttcaatgcgagccggatggattcgaccgtcttgtatcaatcgctctaatgccattttggcaatttcacgacgaattggatcaaatccacttagaacaactgcctctggtgtatcatcgataattaaatcaataccagtcagtgtttccaaggttcgaatatttcttccttcacggccaataattcgacccttcatgtcgtcactcggtaagttcacaacggtcactgttgactccgtagccacatctgcagcacttcgttcaattgcttgggcaattaaatccttagcaactttattggcatcaacttgtgctttttcttcactttcgcgaatcattttagcacgttcatctgccaaaccatcccgaacctcgttcaaaatcaaagtctgtgcgtcttcttgcgacatagccgcaactcgttctaattcttccgttcgttttgtaactaatgaggatgcctcttgttgttgttcgtcaatccgtttttgttcagaacttaacttttcttctttgcgttctaaactatcttcacgtttttcgaaagcattatctttgtggtccaatgcttcttctcgttgtagcaaacgttcttcttgcttttgagcctcagctcttctttgcttaagctcgttttctacttgagttcggtagcgatgactttcgtctttagcctctaaaagagcttcccttttttcggttgccgcttgtttcttagcattttctaaaataccactagctgtatctttagcatcacgtacatttttctcctgaatgagtttatgcgcgtaatacccaatgatatagccaacaacaatagcgatgattgcgaggattatattgaaaacaggcatgtttccacctccgaatcatcaatagttggttaatttctaaccgatttttatgatgttattttgattattcacacaatacctagtttagcattctcaatactgtttaatcaagctatctcaaaatttatattttcatattgctagagagtttattgaaatttaagaaatttttaagttgaaaagtcaaaaaaaatgtttaaattccacacacaatttagaataacgcacacttttagtgctagaccattcattaaccgcattttttaaaactaatttctccttatctttttctgtgtcataacagtggacagaaaaatagccggaaaagttatctttccagccatcatctctattttttatctgaaacttccaaatccaactcggaaggatcctttttttctttatccttatcctttacagcctctgcttctggatccatattgtaggctgcacgaaccttcttgtaaatttcttcgcgtttttctggattgtcttccaaatattgctttgcattctcacggccctgaccaatgcgttcatcaccgtatgaataccaagaaccactcttattaacaatgtctttctcgacagccatatcaataatttcaccagtctgagaaataccatgtccatacataatatcaacttctgcacgtttaaatggtggtgctaccttgttcttgactactttaattcgaacacggttcccaataatatcggtaccatccttaatctgttccgcccgtcgtacttctaatcgaatagttgcataaaacttcaatgcacgaccaccaggtgttgtttcaggattaccaaacataactccaactttttcccgaatttgattaataaaaattgcaatcgttttggttttattaattgatccggatagtttacgtaatgcttgtgacatcaaacgcgcctgcaatccaacgtgggcatcccccatctcgccttcaatttcggcacgaggaaccaaagccgcaactgagtcaacaaccactaaatcaactgcaccactagaaactaatgcatctgtaatttccaaaccttcttcaccagtatctggttgagatagcaataaatcatcaatgttaacccctaagtgttcagcatagacagggtctaatgcattttctgcatcaatataagctgctgtgccgccttctttttgaacttgagcaacagcgtgaagcgcaaccgtagttttaccagagctttcaggtccataaacttctacgattcgtccacgcggataaccaccaacacccaatgcatcatctagtgctaaggatccagtagaaatcgttgaaatttgagtttgggcagcatcacccattcgcataatggaaccttttccaaaatttttctcaattttttttaatgcagcatttaaagctgcttttcgttgttcatcagccaaattgtttcctccttaacgggaatatctaacagtcataatgatactgattattttctaaaaaagcaagcaaaaacgaacaaaagttcgcattattttaaaattttattaatggcttgcaaagcgctcatcacaactctttgtttaacgaacggacgaattgttgaaaattcatacctttttgttgttatcgtgttggtgcgatcaacaatcactatccaaacgttacccttgtggtcatcagttgatgtcgattcgatatgtggctgcgaaattgcgatgccaagatcactgccagtttcatgcttgacttgagtagccaattgttccgtgaccactcgtgatttaaaatcgccttttatatcaacaaattgttggatttgacgttcgttagtaccaagtacaattccaccactcactatgttatgatcggccttgaccgcattaagagttgataaaaataaaccaccagtgtagccttcaacgatcgcaatattttggttcattgaacttaatttggttgccaaaacttgggctaaagagttatgctccccatatccataaaaatactcaccaacctgtgcttgaatctgtttctcacattcatcaagcccctgctgagcctcagaattcgttttagaccaagcagttaaacgtaaagtcacttcattttgctttgcatagggggcaattgtgggattggattgagttgcgattagatttgctaactgagttgttaactgagattcaccgataccaaagaatcgcaacattcgtgatcggagaacatggtcactaaggtatgtttctttaaggagcgggatgacttgttccgataccatgggctctaactcacttggtggacctggcaacaataaaaagtctggtcccgttttttcttgatcaaaaataccgaccgcaaaaccggttcgattacttaatggtagtgcccccttgagatacatcgcctgtaaacgattgttttctgtcattgttcgttttgtttcagcaaagtactgttcaatttttgtcatcgcagatttgtcaaaaatcagttcacgattcaaaaacttagcaactgtttgtttggtaagatcatcttctgtaggtcccaagccacctgacagaataattaaatcacttcgtctggcagccagttttagcgtttcttttaaccgttcaggattatcgccaactgtggattgaaaatacacatcaatgccaagattcgccaactcacgtgctataaatggtgtatttgtgtccgtaatttcaccaagtaaaatttctgttccaactgcaattaattctgccttcaaagtttacctcccactttcaaatacgcttttctttcaaaatatttttttaaattaaaaaagagcttggttagtataagaaccaaactcacttcgctttcctacttaaatccatctgcaaaaacatccctattttgaacaaaataatcaattcctgaataaattgtaaagaacaggcaaatatataacatgatggcagccattggaatatggatagctgcaaacaatacattgtttaaaattaataaaataatggctagcatctgtgatgttgtctttatttttccaggcattgccgccgccataacctgaccattgttctccacaattagtaaccgtaatcctgtaactgccagttcacgacaaacaataattgcaatgacccaagctggggccttgcctaatgaaaccaaaataatgaaagccgacataactaacattttatcggccagtggatcagcaaatttaccaaaattggtcactaaatgattatgacgggcaatttttccatccgccaaatccgtaagggaagcgatagcaaagataattgctgccaaaactttagtgacagcaatcgaggtgcctaaccaggtcaccgttccccacgtataaggaatgaccataataataataaaaattggaatcaaaataatgcggaataccgttaatttatttggtaagttcaaggatttccctcctaattagtcatcaatagttaaagtgattgtctttgtttgggtcgtatctttttgagggttaaaatcaaaactcttaccatttacagtaatcgttgtttgaggtgcatttcccattgtgatagtcacttttgatactcctttagcaatcttttcagtatgtgaagttcctgtttgtaaggtggaagaccagctctgtgtcccatcacttgatactgaaatccaagcattacttgtgcctgccttgaaggttaacttggaaccacttttaggcgcatttttaagggtgtattctgtagttgaactgccaacttgactaatcttttgtgattcagccttggaagaggagcttgaagattcgcttgaactggaatcttttttcttctttgtactacttgcctcattcgtcacactaactctactgctatttaaatggggctgactagaattatttgcgtggctcattccccaaatagtgccaagaacaacaaccacaatcacaacgaccacaacggttggcacatatgccatgtacttaccatatcgtctagaaaattcactttctttttccacttgtttatgttgcgttgttctagaaggtaacggaccggttgcaaagcttttggcacgtgtttcagcttctttagatgcttgcaaaccacctgctaatagcttatgagcatctagaccaaccaccgccgcatattgactcacaaacgattttacatagtagtcaccgggcaaatcattcatttgtcccgcttcaattgccattaaatatcgcttttgaatttttgttttttcttgaatataatcgatcgttaagccttgatctaatcgtgcatcttggagttgcttaccaatctccttattttgtctttcactcatcgcttttcacccactattaaattagtccgctactagtatagcatattaagaatcgttttccggcatcacaaattattttaaccagccaccatcaacataaattgtttgacccgtcatatagccagcctggtcgtctgccaactgaactgcccaataagcaatttcatcagctttagcaaatctgccaacaggaatctcagctgcaatcttttgatgatcctctttagaaaaaacacgattcatttgggtatctacagcacccggagccacaacattaactgtgatacccagagttccaacttcttttgcataggcattagcaaaagctgtttgagctcccttcaccgtgctgtatgcaacttccattgcgcttccgaagccaccataaacggaaccgataaaaataattctgccgttatttgaatgggctaatttagattggaaagcttttatcatttcaataggtaacgcaacttgcatcatccacattttctgaaggtcttccaccgaagtttcagttaatagatgatagtcggtggtgccctgtgcaaaaatcaaagcatctagttcaaaaatagattgcaaaaaaacaggcaagttttcttttgtctgcatatcaaacgcaacgccaaaaaattcttgatgagggtatgccttaataaactggtgaattagttgctgaacaacgactttattttgattgtagtgtaaatatagtgaccacccctttgcagccaattgtttagcaatcgcactaccaatatcacctgatgcgccaagaattaatgcatgcttcataattgagtccctttcgatggttgaatttgaaaggtgctaaagccttttaagtcaagaaagttatgggaaagcaacagcaaatcatctaaagtcatcgtttcataaattgccgcctgatcaaatacagttgcttgatcaaattgggcctcataactgttggcaattgcttctaccgaatccatcctctgtagtaagcgacccatcatttcttttttggccagttgaaattgagatcccagttgaggtagtatctgttcggtatggctcaaaacggctttaatcgcctcctggaacttttctggttgatcagtatcaccactaaagcttgcataatggaaagaccgttccatatcaaagtcatatgaaaacgtatcatcaatcacaccctgatcatacagtttcagatattgctcagaagattcaccaaacaataagtagagcaataaattagctttcaaacgataggctaatcctgctcgtcccaccggaacatcatctaacccttttagtcccacaatactttttggccgattaatatccatgctcacaacctgatgttttattatatcgtcaaaatcggcttcttgattaggtaattttacttggggttcagtaaacttttcgaaattctttttattttgattttctttaatccagcctagcgtcttatccgggtcaacattaccaaccacaaagaggtccatattggctggattataaaaagtattgtaggccgcatacaagtcatcggcagtaatttgggcaattgaattaacagtgcccgcaatatccaaatgcacgggatgatggggatataaatttcctaaaatacccatatagagtttccaatcaggatcatcattatacatttgaatttcttgtccaataatgcctttttctttttcaacagatgcctctgtgaaataaggttcttgaacaaaatcaagaagaatatctatattttcgtgaatattttgggtggcagaaaataaatagctggtcttagtaaaactggtaaaagcattagaatctgcaccgtattcaccaaacaaatcaaaagcatcatatcctttcttatcaaacattttatgttctaagaaatgggcaatcccggccggctgagccacatactctctttgtccttgcggaataaaagtccgatcgattgaaccaaaattggttgaaaaagtagcataagttttgtggaaatctttttttggcaaaatattaacttgtaacccgtttgttaaagtttctgaatataatgtttcgttaaattgttgatatagtcgcttatgcatgttttttggcccccgaactcaagaaataaatggcttgtaactgaacttgattggccaccgtaacgatttccaaacgtgaaacattttgaattgctttaacccattcgttagtcgttgtctggctaccaactaatcgattagtcagtgcgcggctcgtgtatgatctttcagcatctaaggacccaatataatttgagattaatcccgttttaatctgggcgagatgatcatctgaaaaatcattattttgaatgtcctttaattgctgatcgataatggttaagacacgatccttatcttgtgcattaatcccagtttgcaccaccattagaccattaaaaacatccacattgcttgttgcatagtaggccaaactagccttttcacgcacatttaaaaataatttggacagcggtgacccgccaaaaagagcgttgaaaacaatcacagcatagtaagtttcatcccgaaaattcgttggaaattgatacgccaaatctaattttgattgtacaatcatttgttcttcagttttttgctgaatttcttttcttgctaaatttaaccgtgtaatgtcagtatgattattggtacgttcacttaaaggccacttttgaatgatttcttgaacttgagtggcaaccacatcgccaaccacaaaaatttctactcgatcctgggctaatactttttgataatactcaaaaagagcctgatttggaatttcagcaatttgttttgcatctccaaatgttggcacactctgaatatcctccgccccaaaatataattgttgcagttgcaatgccgcatatgattgcttatcatcttttaaagcatcaatgtaagccactaaatttctttgctgacgttggtaagtttgcccatgaaactgacgattttctgtcagtggattaaaaatcatctcttgtaaaaaggccagtccttgatccagcacatgttcggagctagccaaatagtgatcattgggtaacgcgagtgaaaacataagatcatgcacattttgtttacgcatcaaactggtgccaaaacctgcgccatataactgcgacaatttttgtgaaactaaaatttgatttctatatttttgcgaacttgtttctaaaatattggctaataatgaccgatagcttgtttctttttttgatgcgttttctaaaaaatgaacggaaacttgcgtatttttgaactgtgaaacaggaatcactgttaaagtgactcctggtttaatttgaatttgcacgaaataacctcatcatttaacgtattttgatacataaaaaataataccaatccacattagaatagcgtttctatcttttcaatgcaaatcaatattattttagaaaagttaactttttggctgagcaacaacctttgctgtattaccaaaccatttttcattaatttttttcaaagttccattcttatataacacatacaatccatgattaattttcttttgtaatgttttatcgccctttcgcattcctactgcaaattgctctttagggaatttgccttggatttcacgataagactgaggatcgctttcatgtttaatataatagccagcgtacacactatcaatcaataacccttgaattcgatttgcgttcaaatcaatgaaagcatcattaaatgagtcatataaaacaggtgttttatctttaatttgattttttaacaaattgggttgacgatctacgtcctgagccccagacgaaccactttgcacgcccaacgttttcccagtcatttttttaaagctcgttacattttgtgattttttacttaccaaaacttgctcattagctaagtaagtgtgactaaaactaactactttttctcgttctggcgttatcgtaaaaccgttccaaattaggtcaatggttctatttcgtaattcagtagtattcattgaccaatcaatgctttgaaaatctactttgatgccgtataacttaaataccgctttggcaaggtcaatatcataacctgttaattgtccatttttcttacgaaatcccatgggtacaaaactatcgtccaatcccacaataacttttccccgttttttaattgttgaccaataatcggtcgtatttgcccgcttcgtttcattttcacagccacttaagctgggaagaattaacaaacaaattgctaatgtcaaacatattatttttaacttttttttcattgcttgtacctccccaatttacttaactggcacaacgtgaagctgtttatcggcaacttcatttgcaaaatccatatcatgcgtaaccacgatctgggtcatgccgtcttgctttaatcctttaatgatattacttacttctccccgtagttccggatcaagggctgatgttggttcgtcataacaaagaatttttggctgcatagcaagcgcccttgcaatagcaactcgctgtttttgacccccggaaagttgatacggatataaattttcttttccattcagttgcaaacgcgataggcgttccagtgccttctgtttggcaattgcaccactttgctttagtaccatttgcggagccaacgtaacgttgtctagtacagtcaaattgggaaataattgataatcctgaaaaacaacaccaatcacactttcgctacccgtatcttcgtatggactaaattttttattgtttaaataaaattcacctttatcaactggttccaatccgctgatacaacgaagtaaagttgttttaccagctccagaggggccaacaattgttaagatttcgctgtcttcaacttcaaatgaaaggttatcaataatagttctgtcattaaatttttttgttaaattattaatttttaacattgttctaccccctaacgccaatatgcgtagtgcttttcaacttgccgtaatacataagtacaaaccgccgtcaaaagtaaatagataacacctactaagagtaacggaattaaggtaacgtcacgcgcagaagccacatttccggcccgaaggaggtcaccaattccgataacataaactaatgaagaatccttaactaagttgataacttcatttccaatcgatggcaacacaattttggctacttgtgggatcacaattttgcggatggtttgccaataagataaccgtaggaccttcgcggcttcgtattgtccacgatcaaccgattgaagccccccacgaaatatttcggcaaaatatgcggagtaattaagaataaaggcaaacaatgccgcgtcgtacctttgaaagacaattcctacaattggcaaaccataaaaaacgaagattaattgcaataacagtggcgttcctcgcatcagccaaacaaaaaaatttaaaatatatttcaccaatttaattttagataccaagcctaaaccaaaaatcattcctagtggcaacgcgccaatcaacgtccaacaaaatatttttaacgtcatcttggtaccagccaataaagatggcaaaatttgcgatatataatttaatgacaacattgtgatcccctccaataatttataaaaaaagtcctcttgaactataaaaaataattcaagaggacgagtaagcgcggttccacccctgtttgtaattgcttcacaacaattacctcagtgagttgtgcttataacaaaaaaatccccttgggtaaaaatacccaagaggacgcatcaacgtggttccacctcatgtttctgataatctcacaattatcagctcaacaagttataagttacaactctatgagataacgatcacccgtacttctctagttttctcaagaagtaaactcgcagatgtgtttcgaactaggtacatgccttaatctcaccatttaaagctctctgaactgattcctagttctactcttccgttcattgtttttaaatattgtattgaatatagttcattttctaatcaacgtcaagtactttttaatcaatacttctaaagtttgctccccgcgtatgccggaaaagacttttgatcggcaaatataaaatgacaaagaaacataaatttaaggctaatgttggtgccagattataggcaacaaattctggtgacgtaatgcttgtataatgtacgatttcaaaaacgatataaaacgcactctcatatagcgttaaggctaagaaaaacgttagtaagattgataaaaacgtcggtttaaagaaaactttgacccactgtgtaataatcacaattactggcagaataaacatattgaccccgaaaacaccggtgtaaaaccagtcaaacacaaggccaacgccagctgcccaagtagcaattggcaatttcgtctcaccttcgaaaaaaatggccaaaatcatccataagattgtcagattgctcaccattgaatagggatatgcaaataacgaacctgaaaaaattaaattgattgaaccgtctaagaacaatgcgaggaaaaagccaattgggaaaataaattttaatttagcactttgtaacatttataacatcctcccaaactgactatttaagtgcagcaactgaaaccacattaatactgctcatatccgctgctggcttgatgtacacttctgtagctaagccactggagtcttctttagtagctacaacttttcctacatacagccccttaggcgtgacaccaccaagcccagaagttgtcactaatgaccccttcgtgatttttgacttagatgttacctgtcccattacaatttcattgttactacgatcaaaactagtgacaatcccattaattgttgtcccattttcatcctgtacttgaatggcgaaccgattggcggaatcactactatcactaattaattcgaccttacttatggtataactagcttcaatgacacgtccgataagcccttgaccagcaactaccgactcattttttttgatacctgaagcagttcctttattgataaccacaatgttttgccaagaagaaggtgcacgagaaattacggttgcggtgactaaattataatcggtcatgctcttttttaaactaacttgttgttttaactgtttattttcttgttttagggcctgatcccgtgcacgaacagattccaaattatcgactttgctctttaagcgttcattttcttgatacgtattgataattgaattcaacgcttgtgaagtatttcgaattgcattcatcggataagccactacgcgatcaaccacaccaacagcatcattaccaaccttttgtatgactggggtggtagactttttccgggtcgttaccgatagggtcactaatccaactgcgataatcacacagattacagcaatcactaactttcgatttgaaaaaaacttttgcatggtagaccctccggaaattttttatatcacaacaatatctattcttgctcagacacagtttgtattataccacagaaaaaaatgccattacatgcttgttggccaccattaaacgcaccttaatatttaatcactaaaggttgaaactacaaaaacttatcttgttacttaatacgaaaacgttcaagacggcaagtgaattgctgattttgaaccaagtcatttaatactagttattgaagtaattttgatactttcaacctttagtttaatcaaatgagatgctgctccgcaaaactatagtatgtcatgcttcctgtaataatatgatctaacacctcaatacccatcaaaataccacaatcttttaaccgtttggtaaactgaatatcctgctgagagggactgacatccccgcttggatgattgtgagtcaccataattttattagcacccacccgcaatgcttcaaaaaagatttcccgtggatgcacggttgcagaattcaaactgcctttaaaaatcattttttcaaacacaattttattttttgtgtttaaacaaagcaacgttagtctctcctgccggtatcgtctttgcatgtgaatcagccgttctccaatttgacgactcccaaaaatttcaccaataattttttgtggtgctaactcaatacggcgacctaattctacacacgccaaaaattgacgatttagttcaggataatcagcaaatatttgctttttttctggattatataacagtgaaaacaaagataaatctggaatcaatttccaaaaatctgctagtacttgacgttgctcattgattggtaacttatcagtcaaaaaaacttgtaaaagttcctcattcgtatactgagccatttcatcaaaaggtttccgcgcaacttctatttgtgtcgtctgcatatcatttttcattagcttttcactctcctaataacaaaaatacgcacaactattacgattctacgaataacttacgaacatctgaaataaaatataaagatcccgtaattaggagtaaatcgtcactagacatgatgcgactggccttagcaatggctagctgccagttttcttcagtttgaattggattggccgtttcaacactagttgttaattctgttaaattggcagcttggcgtttgccaggtccagcaaaagtggttgcgataatatgcacgttgttcaaagcacccaatgtctgaatcattttgtgatattgcttatcttcaagaatcgcaatcacaacataaatatcgtactgtttaaaatgagtcccaagtaactttgtgatttcttcaaatgctggttcgttatgtgcaccatccaacaccacaagtggttgttcatttaccttttcaaatctaccagcccaaaaagcttttactagcccacttctgatattcttctcaagaactggtacattttgttgctttaaaaatatcagataagcttgcaacgcggtactggcattattgatttggtaattacctagcattgaaatttttaaatctttaaaatgataatcagtcgtcgcaaagtcaaatttttgcgtccataaatcctgataacgacgattattaactttatatgtctcatcaaaacaaaaatagctactatgatgctggcgagcagttttaataataacttctaatgcctcatcacctaattgcccaataacggtcggcacattttctttaataattcctgctttttgtgtcgcgattttacctagggtattacccaataatttcatgtgatcaaaaccaatattcacaattaccgagactgcaggcaaaaccacatttgtggaatcgaataagccaccaatacccacttcaactaacacaacgtcagcatgtccttcagcaaaatagctatacatcatagcagtaatgatttcaaattcggttggcccgccttcaggtaaagtcttatctagttcgtcaatgactggtaatactttctgaaccagcctcagaatttctgcatccgaaataggctcaccgtttacactaatgcgttcgttaaaacgtgttaaaaatggtgaagtaaatgatccgactttgtaacccgtttcttgtaacatactccttaaaaaagtcagggttgagccttttccgttcgttcctgcgatgtggatagcctgaatcttattttggggattatccaatgccgccataaacttggtcatccgagccaacgtgggaatttttttaaatttggtgcgaccatgaataaaggcaactgcttgctcataggtctttacttcagtcaaaataccatctcctcaaatcgaaaaaagactaaacaaacatctcgttttagtttagtctcttttcataaaaacttgtttagttactgtgcattttttagtgattcaagtcgttgttttgttgctgtcaatttagcctcataatcggtctgcttttgacgctcactatcaaccacttcagcaggagcattggccacaaatcgttcgttgccaagcttcttaatcgaacgattaacttcaccagtatacttatcaacttccttttggaggcgatcagcttcgtcgtttagatcaactaattccgctaatggaatataaacttcggcatctgtaataactgctgacattgctaacttgggaatttcaagatcagcacctatctcaaatttagctggatgacagaaacgttcaatatactcatgattggtttcaaaaagcgtctttaggtctgcattatcggtcttcacaagaaggtctacagaacttgacattggtgcattagcgtccgcccgaatgttacgaactgccttaattaaatcaatcaagtgtgccatatcattttcagcctgcctatcagctagttgtgcatgttccactgggtaggctgcggtcacaatggaagcaccctcgtggggcattgcttgccagagttcttcagtgacaaatggcatgatcggttgaagaagacgtaaggtctgatccaaaacataagccaaaatattgcgcgtattggccttggcttcttcatcatcacctgtcaggatttccttactcatttcaatataccagtcacagaagtcatcccaaatgaaggtgtaaagggcacgaccagcttctccaaaatcataagtatcaaagaagtgggtaacctgtttcacagtttcgtttaatcgacttaaaatccacttgtcagtcagattccatttgctttgatctggaagcactggttgtgtcatttcaccaaggttcatgattacataacggctagcattccaaatcttattaataaagttccaagcagcatccattttgtcatagctgaaacgaatatcttgacctgcagttgaaccttgtgataagaaccatcgcaacgcatcagctccatatttattaatgacatccattggatcaattccgttacccaaggacttactcatcttacgtccttgctcgtcacgaatcaggccatgaagcaaaacatccttaaatggtggtttcccggtaaactcaaggctctggaaaatcattcgtgaaacccagaagaagatgatatcataaccagttaccaatgtactggtcgggaaatagcgtttaaagtcaggtgcattttcatctggccagcccatcgttgaaaacggccataaggcactggagaaccaagtatccaaaacatcgggatcctgttcccaattttcaatatccttcggtgcagtttcaccaacataggtttctccagtttgtttattgtaccaagctggaatttgatgtccccaccataattgacgcgagattacccaatcatgtgcattttccatccactgtgtaaaggtatgctcaaatcgttcaggaataaaattaaccttttgatctgatttctgattttcaagggctaagtttgccaaatctttcattttaacaaaccattgggtggacaaacgagcttcaacttggacacctgttcgttctgaatggccaacactatgcacgattggatcaattgagatcaaataaccttgatcctgtaaatccttaaccatggctttacgggcaacaaaccggtccattccttcgtacttaccggcattttcattcatcgtggcatctttattcatcgtattgattctggccagattatgccgattaccaacattaaaatcattaggatcatgtgctggtgtgattttaaccatcccagttccaaactcaggatcaacatactgatctgcaataacgggaatatgacgcccttgtagtggcaacacaagctctttaccaactaattctttgtagcgttcgtcacttggattaaccgcaactgcagtatcacccatcatggtttctggacgcgttgtggcaatctcaatgtaatgattaccattgaaagtgtcttcttcattaacgaatggatacttgacatggtaaaaggcacctttgtcatccttatgaatcacttcaatatcggaaagtgctgtttgagcttgtggatcccaattgataatgtattcaccacgataaattaagcctttgttatataaggtcacaaagaccttttttaccgcttttgaaagaccatcatccaacgtgaaacgttctcgagcatagtctaatgacaatcccaatttagcccactgtttatgaataacatcggcatattcatctttccattcccaaacttgtttaacaaatttttcacggcctaaatcataacgtgagattcctttttcacgtaacttagcttcaactttcgcctgagtggcaattccggcatgatccattcctggtaaccatagggtatcataaccttgcatgcgtttttgacgaattaacatgtcttgcaatgtcgtatcccaagcatgccctaaatgtaattttccagttacatttggcggtggaataacgattgaataaggttttgcttttttatcgccacttggtttaaaaaggccttgatctaaccattgttgataacgaccctgctcaactgcatgaggatcgtattttgttgacatttcctttttttctgtcatatgagtattcctttctatataaaacaaaaaagcatatccatccttcaaaaggacgaatatgcttcgcggtaccacctaatttgggtttttaaccccacttacttcttttttaacggaattaaaaatttccggtcattcttactgttagttcagaacaacggctcacaatctactaaacatcttgcgaaaactttcagcatttattttctctcttttttaagatgtttttttcttgttcatagcctatataagcattttagccaacattcagtgattagtcaacttcagttgcgtattttttaatagcatccaatgcttcaatataatttggttcatcatgaatttctggcacaatttggcgatacacaattttaccctcagcatcaataatgaagattgtgcgtgctaagaagccatcatttggaatgtataaattcatttcatatcccattgataactcttcgtcagaaagaacttcaagatttgaaacaccctctgccgcacaccatgccttctgttcagaaattgtattgttagaaacagtcacaaaacgaacggatggataatggtctgcttgctgattaaactttttggtttcaatcttgcagacccgggtatttaaatctggaacagtactgattaatgttggtttcccaattaaatctctggtcttaattttctggttctcagcattaaacaacttgaactttggtaattgctcacccacttcagggggattaccagaaagggaaaccttttcgccattatttaaaacatccacattcatcactcctcaaattcagtaacttacctatcaaaagattaacctaaagataacccattctaagccaacaatcaaatgaaaaattgatgatttatagcaattctgcaaaaacatcctcattttgattcaagaaattttgatcaggtttaatttcggaaatttcaatgccatccaaagcttcttgcattaggccctcgacatcaattcgtttttcataataacgggttcgctctgtgtccggacgagtttttggagctggtggtgcaaaaatagtacaacagtcctcaaaaggtaaaatagaaagatcatatgtcccaatttgctcggcttgcttgataatctctgttttatctaaagaaattacaggtcgcaaaatcggcatgttagttacgtcattaatagcttccatgctttccatggtctgagaagcaacttggcccagtgactcgccattaaaaatagccttcccgcctcgttttttggcaagtgcaacggcaattcttaacatcatccggcgttgcactgtcatcaagtatccttcaggaaccttttctttgatttcttcttgaatttttgtaaacggcacttgaataaactgtaaactcccaccaaaagcagccaacttagaagtaagttctttagccttcgctaacgcttgttcactggtgtatggtggactaaagaaatgtaccatctccatatcaacgccacgcttcattcctaaatagctcgcaactggtgagtcaatcccaccagataacatcatcatacctttaccagctgtgccgactggtaacccaccagcaccctgaatagtttcgcttgaaagaaagacgccattgttgcgaacctcaactcgtaaaatcaaatcaggttttcgcattttgacaactgccttaggaaaattatcaaggacaaatccacccaactcttcgttgagctcgttggtatccatttcaaagttatgatctgaccggcgcgtattgatcttgaaggtcatcccaggtttcaattgttcagtcatcatctctaaaacaccttgatgaatcgcatcaagggtccggtcaaccttaagcgatggcgagaaattttgaataccaaaaacttgttttaaccgttcaataacggcatcagaatcttccccatttaaagtgacatgagtgcggtctcgctttggatgcacttcaagttttggaaatgcatgaagacttttacgaatgtttccacctaatcgattaacgaagtctcgctggttcttcccttttgtggaaagttccccatagcggaccataatttccgtatactgcatatcagtaactccttgtcttaatttaatttagaaaattccgcatagagtttatcaaacactttgttaaactcttctgcttcggcaactgtattgtcagcgtctaaactcactcgaattgcacttgttgcaatatcatctggtgttttcattgcggccagcgtacttgattcaacttgtttcttggaggaacaggcactcgtagtggaaataaaaatattgtagcgctcaaacgcatggacaactgtttcaccgcggacccctttaatcgcaaaacacagaatatggggggcaaacccatcattgcgttgggtaaacatggtgacatttttaaacttgctaacatgatcaaaaattgtttctttgaccgtttgttgctgtttaacatttgctggctcgtcttttagaagaagacgtaatgctttcgccatccctgcaattgcaggtaaattttcagtaccgctgcgttggttcttttcttgaccgccaccagtcattagaggtgcaatgcggcgaccttcccgagcataaataaacccgattccacgtggtgcatgaaacttgtgcccagagaaagtaacaaaatcaacccgatcattaaaaattgcggactggatacctttaccaattccttgaaccgcatctatatgaaaatgaatctttggatattttttaagaacatctgacgcctctttaatcggttgcagtgttccaatttcattatttacggccataattgatactaaaattgtgtccggacgaatagcagcttctaaatctttgatcgaaatccgtccctctttatcgacgggcaagtaagtgatatcgtaacccaagcgtcgcaactgttccatactatttgtaattgcaggatgttcaaccgcggttgtaattaaatgtttaccaaaggtccgtttctcaattgctgttcctttaacaacccaattatcgccttcagttccaccactggtgaaaaaaatttcgtggggtttgacattcaacaaatcggcaatctgttttcgtgactgctccaataaattaaacgcagtttcacccattgcatgcaaactagacggatttccccaaattttttcactaaccgtttggtaggtttttaaaacctccggggcaactttagttgtggcactattatcaaaataaatcattctattaattctcctactatccttaggacttcacttgaaaattccttactaattataacaaccttatgaatagtcaacaaggttattaacaaactccacctatgatactcaaaatcatcaataaaaacaaagaattgtaatccgaattacaaaatcagtcttttccataacaaattgatctttcaaaattaaaaagcaacgaaaactaaactatcagttttcgttgctttaacttaaaaaattaaagattaatactgcgtacttttttgtttttgataactctcagttaactgatccaccattcctggctcaacactttccaatgcccgactaataacacttaaactttgtgcataatcatggtcttcatcaaacaacttttgtgcccgtttgctggcattatcaaccgtctcattactgtgacgataacggttggtatactgaatgatttcttcacttaacgcggcattatcggtaagttcagttgttttcttggcaagagactgcatatctttatcaatcatacccaattgttgatcaatttgtttcatatcgattttgacttgattcatattggaagaaagcttttcaatttcatcactcacaacaaagaagtaatccatataacttgcagggattcctggtaagtttaagttttcaatgtggcgtttgatctcatgaatttccaaatcaaattggtgtaatgttcgacgagaatctttttcttcttcaatcaacttttgaatactttcgttaattgcagtttgttgagattcaatatcatcaagttgatcattttcttcatgcatccgttgcaagatttctgaataaacaacaggttgatttgtaattgcttctgcatcttgatcatgttcactacgaatatcttgaagttttgcttctaagtcatgagcttgactatcttcgttaccattcaaaacataactttgccctaatcggtcgatttcaatcagcaaagtatgactttgcttttcggcgtgttcaatgtattcggcaattgtttgaaaaccaccatcaacatcggttcgagcatcaatttcagtttgcattaaatcataaagattatctatgcggtttgcaattgtctcgttattgccctttacagcgtcaagtcttagattactcaaagtatccaaattttcgttaatttttgaaccaatatcttcaatgtcattaggaatttcatcgtccgcaaatgcataattatgattgatcaattgcgtatagccatttttaatttcatctaattgaccaggaaaatcttcatttaattggatgtaaagttctgggattgcctcaagctgttcttccaaaccttttgtactggtctgtaactgttgtaactgtccttcggctttcttatgatcgccgctttccacagttttagcaaaattctcgaaagcattctccagtcgctctaaactgtcgtttaacatatcaatgctaggaccataagtcatgttcttagctaacagggtcttacgtaggtcttgatacttgtgacgcagaactttaacttcgttttgttggtcttcgctttcctgcttaatttgatctagtgctgcttgaatgcgatcagattccgattgaatcacctggacagcgtctttaataccagaaacatcagaacgggcatcaaaaattttcatgtcattcacgttctgctgaccggtttctgcaagttcgtcaatttcaggaaatttgttgtttttgacgttccgataatcatcttgaagattttggtattcttccaaagaagaacctgccaaatttaagttaccaacctcatcaagctcgctggcgacgggcagatccatcaaatcagatttcttattttgaagatctgtaatttgcttcaataaatatcgctgatacagcacgatccctacataaataagaattgccaccacgattataccaattaatacacccaacatgagaaccccatcctttgtctacgtcattttcattaaatgaattttgttgctttcttgtttttttcaatataaaataagactcaacttaaattatagcataggattttagagtttcactatgtgatttttatatttctagtccaatttggaggaatttttatgacacagaaaacactttcactaatgaatcaacaattagatgcccttttaactggcgaaactaatttaattgcaaatatggctaatgcttcagcacttttaaaatcaagttacgctgatgtgaactgggccggtttttatctctatgatcaaaaaggtgatgaactcgttcttgggccttttcaaggtaacgtcgcttgcatgcatattgccaatggtaccggcgtttgtggcacagcttttaaagcaaaaaaagttcagcgaattgctaacgtgcatgagtttgctggccacattgcttgcgatactgccagcaattcagaaattgtgcttcctctcattaaaaatgagcataaaattggtgttttagatattgactcgcctttacttgatcggtttactgaagaaaatcaacaagaacttgaggactttgccgctgttttcttgcagcacattgacactgttgcttaacttgttgtaaactgttcattgtgtaaaataatgcagcggcgagtggtaagctcgtcaacagactggtgccttttaattggttcaattagtaaccttgcggctgcaaaggtgaggattgcaaaacagtctgcacgaatactaaactcgcaatcggattattttactccaacaaaattattggaggatttactttatgtctcgttatacaggtccaagttggaaaatttctcgccgtttaggaatttctttaagcggtactggtaaagaattagctcgtcgcccatatgcacctggtgatcacggtcaaaacaaccgtcgtaacatttcagaatatggtcaacaactccgcgaaaaacaaaagttgcgtatgatgtacggtttgacagagcgtcaattctcaaacttattcaaacgcgctggtaaaatcaatgaaggtaagcatggtgttaacttcatgatcttactcgaacgtcgtttagataatgttgtttaccgtttaggtttagcaaccactcgtcgtcaagcacgtcaacttgttaaccatggtcacattaccgtggatggcaaacgtgtcgacatcccttcttatgaagtagaagttggccaggttgtcagtgttcgtgaaaaatcaaaagatttgaagatcattggcgaagctgttgaagctgtcgttggtcgtcctcaatttgttcaatttgatgctgataagttggaaggttccttaactcgtctcccagaacgtgacgaattagaggctgatatcgacgaatcactaatagttgaatactacaacaaactttaattttttattgtttgttcaaaaaaagcgtttggaagaaattccaatcgcttttttagttgtcccaaattttggataacacgctaatcgtttgctcgatcatttctagtactgccgctttgctatctaagttcctattatccttttgtaaaacacgaccaattagaacctccgcctttttctgaaatctgtactccttgacgctcttctcaaaatttcctttcgtcaatgaaataaacgattttgccatgtgattgtttgaaagcttaaactgggcacctaaatttaaaaaaccagcttgttttgacttgagtttatcaatcgcggattggcgctcctgcatatttgtttcaaaggccaaccacacaaacaaccggtcatcccaaaccccaatttcataatgaggcaccattttatagccccgcttgttttgagcaaatgcgacccacgtatttggtggtggattagaatgacggcgcgcatgttttgcaataaacgctcggtaagtttcaccgttcccatttaatattggcagcacttcttgaatagcttcctcaaaaaaaggatcaatttgagtacgaactaactttaatctttcctcaacatcaggttcattaaatacagaaaatatgtgctctctaaacataaatagttacctccttagtcgccaaacaggatacccttggcggaaaatgctatacttattatactatctagaaaggttgtgagcgcaatggctaataattccaataacgttgactcgcggttacagaatgccattcatggcacccctaaactcaatccagatgaacaacgaaggtatcttggtacttttcgcgaacgcgtggctatttcaatgactgtttctcaaataaaaacgcaccaatacgaggttccatttgtggcacaattaaaaaaacaccctgattatcagctgttgatcaatggtaacattgatcaacacttgattggtccttatttaaaagcagccagtcaggaatccttaaaattcacaattaaaactgacagcatttatacaaccaacgatcaggacttggcccttgttttagcagcgccagattcaattaatgttgctgacattgatgtggccagtttccaaggtcaggcacctattaaagaagaaaaaaaaccagaatcacttctggataaacttaaaaatagttttcgaaattaggagttttatcatgcaacaaccattggcgtatcgtatgcgccctaaaaaaattgaagaagttgttggtcaacaacacctagttggcccaggaaaaattattgcccgaatggtcaaagctaaattactatcgtccatgattttatatggtccaccgggtactggaaagaccagtattgcgagtgccattgctggctctacgaagtatgctttccgcaaattaaacgctgcaactgattccaaaaaggatcttcaaattgtggctgaagaagcaaaaatgagtggtacggttattttactccttgatgaaattcaccgtttagataaaactaaacaggatttcttgctcccccaccttgaaagtggacgaattattttaattggtgccaccaccgaaaatccttatatttcaatcaatccagccattcgaagtcggacccagatctttgaagtccatcccttagcaccggaagatatccattctgccatcaatcgcgccttaacagacaccgaaaatggcctgggttcaatgaatgttaaagtggctaaaccagcaatggattttttgattcattccacaaacggcgatctgcgtagtgccttaaatggcttggaactcgctgtaatgtcgactgaaccagacaaaaatcaagaagttcatatttctttagaaatcattgaagaatgtctgcaaaaaaaggcgctcactcaagataaaaatggggacgctcactatgatgtgatttcagcctttcaaaaatcgattcgaggtagcgacgtcaatgcagcactccattatatggcgcgtttagtagaggctggtgatttgccaagtatatcgcgccgattaatggttattgcgtatgaagacatcggcctggcaaatccgcctgcctgtgcaagaactgtttctgccattcaggccaccgaaaaacttgggtttcctgaagcacgaattccattggccgatgcggttattgaactctgtttatcgcctaaatcaaattccggcatttccgcaatggacgcggcattaaccgaagttgaatctggcaactatggagacatcccggctgacttaaaggacgcgcactataaaggcgctgctaagcttggtcacggaaacaattataaatatgcgcataattaccccaacgattgggtaaagcagcaatacctgccagacagaatcaagaatgccacctactatgaaccaaaagaaaatggtaaatttgagactgctttagcagaacaatacaaacgcttgctacgtgctcaacgtgattaatcttcagagggactgaaattgaaattttataatatccatgctaagataggtatgaaatttctttggtgtacgcgttgtttcatttatgtactgccgttcaaataatttgtatagggactaagggtgtttggtggcatgtaggcctttaattaggaaacttaaagtcaaaccaattggtcccaccgctaacatacttgcgggctttcactgagaaacgattaacggcaccacaaagtatttccaaagcattatgctttgatgggattaggacattacgtgctaatccctttttgtttatttagccgttttactatcgatttatcaaataaatttcaaggaggaatactatgctgatttcagctcttatggttcttttttctattattcttgccgtaattggaacttacttatatcggcaccagcagcaaccttttctcctattcaatccaactgagaatccagctctacaagaacttttacgaattggcggtcttgccctcattttaatggctattattgcttttgtcatcgcttggacacatgtgatcattctaatttgtctgattcttcttttgggctgtctatctaccactgcaattctaattggactattaagttttttaccaaaataactacctgcaaatgccgattgtctcccattgtagccgtttaatcaaaaagaaaacgctcttttttctttttattttgggtaatttaacgtaaaatggagttagaaagttggagaggtgatttatatgacacaacaatataaacatatactggttcctgttgatggctcaaaagaagctgaattagctttcgaaaaagctgttgcagttgctagacgaaataaaggttccgaattacatttggtacacgttgttgatacccgcgcatttcaaaacatctcaagctttgatacagcaatggttgagcaggttactgaaactgcaaaaacaacccttgataaatatgtggatgaagcaaaagataaaggtttggaaaacgttgattattcaattgaatatggtgcaccaaaagttgtgatcgcaaatgacatgccaaaacagttacataccgatcttattatgattggagcgactggtttgaatgccgttgaacgtctcctaattggttcagtgaccgagtacgttacaagaacagcagtttgtgatgttttagttgtccgcactgatcttgctaatcaaccagttaagattaaataagaacttgtttttttaaaataaaagatgcccgagaaaataaccattcttcttcggacatcttttattttgccacatgctttctattgaacagctagattatgatatcgaaagcaactcacttcatggtcattgataagacccgctgcttgtaaaaaggcattaatcatttttggacccacaaaaatgaagccatctgctttcatttgacttgcaatcctatttgttaaacaagttcgcgattgtgaatcatccaaaactacttgcgaattcctaatgggttcaaaatctacaaactgccaaatatagtctgaaaaattcattggtagattggctacaacttgtgcgttttgaactaccgctttaatttttcgctcattacgaataatcgttgcatctgtcaaaatctggctaatatcatagtcagtaaacaggcttaatatttgtggatcaaattgcgcaaagacatttctaaaagcttctcttcttttcaggacagttacccaattcaaccccgcttgaaagatttccaacgcaaaacattcaaataaactttgcgtatccaaaattggaacaccccactctagatcatgatactgtttcaacaattcatttttatttccccacatacaacgattcatattctcattcctttctgcaacaagaataagattcgcatttttaccaaagttcaattaaattattgatcacttcatagcgacttaaatccgccgcatttctttcgcgaatgactttctgtaatctctgcacatgatttgtaatcatcccatcaactcgcaacgctaacattcgcttcatcggttcaatgccgtccactggccaagcatagacttttttatgctgtgcccaagcctgctgaataaactggcgattcagtgtatgaaattcaagggaataaaaatcagttgaatttttaggcattagcgcaatgttaaacggcgtaataatccctgtcactaaatttggccgttgcttttttagttgggtcataaaggtggcattcaaagaatgaaccatatcgtgatgtgtttctaagctatggccatactttttattaaatagggtcaccagattagctgtgtcatttttacttgccttgatctcaacaatcaaaggctgttttaactgatgggcagttttaaggtaatcggaaaaactgctaattttagtttgatagccattttctcgaatggttaaatgtgttaattcttttagggttagatcagaaactgacctattttttctgcccaaatgatacagattactatcatgcatgaccacaaactgatgatctttagtttctcgaatatccatttccacataatcgggttttagtttagccgtttttctaagtgccataatcgtattttgcacaccattatgatcacttacgccacggtgtgagataactagcacgtcagttgaatgattctcattcatccgaattgaaaaaaaggcatacgtgggtgtgctcaaaaataacagacccaataaagcaatcccaattttcttgatttgtttcaaatcccattgatgataatttaatcctcttgttttgaataccgatgttttcgctagtggcatgtttacgactctaacccactcacccaatcgtgacaaaaaaccagtcataaaaactaaaaaccaaccaacaaacaacagttcaataaatgtaatcgctaaaaccatcaaaatagttgatggtaagtctgaatgcatccagctgttccaggcaaatataccttctagaataaggctcccaattagcagaaacggtacggaaacacgaacaacaatgatcaaaatctggataagcatcctgcctgtctgcccttttgttaggcgccaactcagtcgaattccttcagtcagtgaacattgataactaatcattgctggaagtgctaaaagcattcgcagagctatgtaacaaaaaataagatacaaaagaataaaaacaggtgcgaccgtccagcgattagcaaaaacaaagttttgaattgaaacgcttgttggaatatgagccagaatgacggttgcaaatccaaatccacctagtggaatcgtaattaccacataaaaaaagaaatatgcaatactaataatccaatttctttcaaacaacttttgtaacaaatccttcaaatgatcgaagttaaccggcttacgttgctgaaacccactaatcattagggatgctgccattaagccaacaaacatcccccaaataataagaaccgcaaaaataaattttaatgggattaataacggattttctgaaagaaaaagtgcatgctccaataggatgctagttacaacaccaactaatagcgtcaaactggcataatacaaattttcatctgatttaatcatgtaattaattaaatttttaagttgataaaaatcgcgaaatatgaagcgtttcataacagtcactacccccgttgctggaaaattgctttcgctttaatcttaacattatcaagaaatgaactaaatgctctgaaaaagaaaaacgcgcgttccttcatcttgttagtgaagaatttgtcttttcctttacgttttagctatcaattttcattaactaaaaaagccagagaaaaagttttctctgacttctttaaattgttactctgcatcaagcggtgtgaaatcataatgaattttagaacgtcgattaaattcctcaaatgccaaatcaatgagttgatcaattaacctttcatagctaatcccagacacttcccaaagttggggatacaaactaatgtttgtaaaaccaggcagcgtattaatttcgcttaggtagggaactttgttatgatcaaccaaaaagtcgattctagctaagccacagcaaccaagtactcggaaagcatccagtgccatttgttgaacttcatcagaaagctcactagaaatgctagctggtagttcaaattgaaccccactggcatcgacaaacttattattataatcatagaatgtatcagatttcggtacgataattcgtcctactttagaagccttgggatttcgattacctaaaatagaaacttccacttcttctggttgttcaattgattgttcaaccaacactttaaaatcatatcgaaaggcatcatccagcccagtttcaaactcttgagcatttgtcgctttatgaatacccactgatgatccttgattagcgggttttaagaacatcagctcacctagtaattcgcgacaaacatcataggaatagtcgccacgattttcgggtgtcacaaccacatactttgtgttacgaatcccattatgtgttaataactgtttagttgtatccttgtcaaacgaaacagctgaagcaagaataccactgccgacataaggcttttgtagtagccgtagcaagccttgaatcgtcccatcttcacccaaattaccgtgaataattgggaaataaacatcgatatctttttgttcactcaagttcaaaattggtgacaatggattacccttatcaaccgatttcatggcatctgccacaactttatcttctgattcgccatcaaaaattcttcttgatgaagcatcactcaacaaatagccatcttttgtaaccatgaacagactgacttcgtaacgctctttatccattgcatcgaaaatattatgtgcagaacgctttgaaacatcatgttcagatgaattaccaccaaatagcaaaccaacgtgaatctttttttccgtactcatttaaaatctcatcctatcacttagattttgtattgaacctaaattgtaccatgaatttgcagagaaaaaaactttaatatccaaactatttggcatcaaaatcgccagttaacacgactttaccaatcattttattagtttcaacaagttcatgagcatgtcttagagtcgctgcgttaattcccggaagcgtcacagttaaagttgatcgaatctctttttcatccaaaagtgtggcaatcttttcgaggattgttccttgtgttgccatatctgcagtctgataaatactttttgtaaacataaactcccaagcaaaagtaatactcttagattttaaaagtcccattggtaaaggacgttcattttccacaatggaagtgataaatccttctggtgccacgagttttgccaaaattggcaaataattatcagttgagtgaaaaatcaaggcaaaccctacagactgaatgccaactgctttaagttggtcagctaacgatttgtgataatccaaaacgacatccgcacccatttttttaacccattcaatcgtctctggtcgtgaggccgttgttaaaacttttaaacctgcccactttgccagctgaattgccactgaaccaacgcccccagcaccattaataatcaaaatctgctttcccaaattagcatccttttttggaattaatggcattcgttcaaaaagagattcccaagccgttaaactagtcaaaggcatggctgccgcttcttccacactaatattttgcggtgcatgggccacaattcgcgcatccactaactgcaaagcttggtcactcccagaacgattattggttcctgcataaaaaacatgatcccccactttaaagttagtcactttctgccccaattcaacaacagttccataggcatcaaatccaagcacagttggaacacttgtttcaggatggccttgacgaatcttagtatcgaccggatttacggaaacggacttaacttcaatcaaaagatcaaaatcatttgccttaggacgatcaatttttaaattaattaaactgtttgaatcttcaattggtaaacctttgtaaaaaccgattgcatttatttgttcactcattaaaatatctccttaaaaacgaaaatcattttcctcatttaaatatgaactaacttcttttggcatttctggatttaagactaatgcttgcaataatcgctggcggttgtacaggcgcgtccacatctgttcatcttctgtcgtttgaatcgacactaactcatgacgccaattttttagtgctaacaacaaaaagtcggtgtaaagtttgttttgattagttaaatccgcaatgtagccacctatgcgctctggctcaccaaaaattagtggcgttgaaagccgtttgtaccgagctaataaaacagctaacatgagtaatttatccgctctaaccaagctattatcaactgctaattcatccaaaacattgccaatatgcgtataggcatgtgcccagcccttcttaccagaataaccccgtgtatctgtttctaaggctatgtaagtaaccaattgatcaacaagggtatttttactctcatcatctataaagtgtgatccagccctatctatatacaacaaggttgataaaaacattaaactaaatgatctcttaaacacaccgtcattttgaggttccagaatgtgatcaaacaaactttcatcctgaatcaaatggtcaaaaatcatttttaattgttttttcgaggtgatttgttgctgcaaaatatcactaaatagaaaatatacgcctttatcacgaatcatcaaatcaggcgagccaatatgttgaaataactgcattaaatccttatcggaaacttcttccagttcgtgctcattcaactgatcacgaagcgactgaataagatcccgaataccatcgtcatcatcaggcaagtgaacttctgttggcgccgacacatctgtcgacataataatcttatcaatttccggaagtaacgactgataaatctgaccaccttgtaatttaatccgtaaattttgtagtctactgcgtacttcttcaacttctttcataactttttctcctcgtaattaatagtttaattttaccacgtctccaaacctaaggtactaataaccagtctcctcatttcaaattacttcatcacattgtcaattcataggttcatggtaaaatagaaaaaaagaggaggagtctgtcatgtcatatcaccaaatccgtcgcgaattaaaaaaagaagtcaaacaagtttttaagggtcattggggtcaagcttccatgaccgcagtagttccaattgtccttagagcaattgtgggatttatcatttccctaggtattttgtttggactgtacttgctcattaagaatcctcaccttctcaataatgaagttacaagctatgctaatgaggagtcaccaaattccggttcatccaatgtttggagctttttacgaactgccatagttacatttatcagtgttggggttagttacacattcctagactggttacgcgaacctaatcgcgatttttcacctgtgaaaagtgcttttcaagtttttaccaaacgctatttcattccaactttggcaatctttgtactccagttcatttatttgtttttttggactttattactcattgttcctggaattattaagtactatgcctactcccaatcatacctgatttacaaagatcaattagccgctggcaatgcgggtcgcattgaatacaatgactgtatcacaatgagtcgccaattaatgcaggggcataaatttgaatttttcttattaaaattaagcatgattggctggtatgttctttgcttatttagtttcggaattggatttatctggtacgttccatattctcaagcgatctatgccgcattttataaacatctcgttgctattcaataaacaaaaatgagaccgcaacaaaaactgtgtttttgttgcggtctcattttttactgattttttaagacaatatgttgttgaatccagtaattaatgatcgtacccaaaataatcataatcgccataaatccaaccgggtggaatggattccattccccttcgttagttgtttctgtataaccgaccacaaatttgataaaattcatcgtccaatctaaattcatgccagtatggaactgcattaaaaaacgaactaacacgacaagcccaatggggatggcaatccacaacatgcgccgggttcgcttcttcaggagtgccgataaacttccaaaaaacatacccaaaacagcaaaactccaaagtaataaccattcataaagaatttgagctggaatattccaaaaactatgaaaacccaggaactgaccaaaaagttggttataaaaagtattatcaacatttccaacgtttggtaaaatcaccgcataataataacaataattgattacgctcatcaataaactaagcagcgcggtcacccaaatggttgctttccaaactgttcgacgagaaataccattttggatataaaacttaaatggtccataaactcgatatgatgagattactaaaaacagaatcgaaataaatggtaataaattatttttcaataaattatgaattgaaataccatcaaggcttcccgtgaatagcaacgcaaaaacaatcggtaacaggaaaataaacaaaaaggttagaatataagtgtaccccagaccctttaaatagtatccaaatttattcttaaaaatcattttagttttcatttagataccccctcgccacttgttaaatgaatgaagagtttttgcagatccattcgtgaaatttgaattgtatccggaatctctcgatcatcatttaggttgccaaacacatagttacctttgagatttccaagtgattccgttccaatcacgtttaatccctctgtatactgatcaacggtttctccaggaccagtgatcacatatgcctgtgacaacatatggtccacatcatcatcaactaagattttgccgttttctatcacaaaaacatgctcaatcatattagcaatctcttcaatcatatgagtagaaatcacaaaagttcggggatgactactatacgtatccaaaagttctttataaaacaactcacgatgattagcgtcaagaccaagaataggttcatctaaaaaaacgtaatcaacaggtaaacaaagggcaataattaatttaaagatcgtgcgataacctgttgaaagttgaccaaatctttgtttcggatttaactcaaatgcctcacacaagtgttttgcgtatgcctcattgaaaccgccatacatattctttgaagatttaaataaatcttgtaaacgagccctttttggataaagattaacctcactcatcaaatagatattgcctaacaattcatcatgctcgtgtgttggaataccatcaatggtcaccgaaccaccatttgcaaaaatgcggtcggtaataatatttaataatgtacttttgccagcaccgtttctgcccagcagaccgtatattcgatttggctcaatctccagactgatattttgcaaaatttgcttccgaccaaattttttggcaacttccgtaaccttaatccccatttgtttgaaacccccttttgataagttgaatcaattccgtttctgataactttaaatttttagcttctgccacaattttttttacataatcctcaaaaaagtcattttgccgtttttccagtattaactgataggccccttttttcacaaacattcctaaaccacgccgtttttccaccaatttttcagtgacaaggatattcatgcccttcaaaactgtcgcggggttaatatgaaattcacgagacatttcggttgttgaggggacctgcgtttcttctttaaaagcacctgtaaaaattccttcttcaatttgattagctacctgtaaataaatgggttcttgcccactaaaatcaaattgcatatgatcaccacctcaagactgcatgtttatacttggaaccactaatttttcataaataaacaatgtaattaaataataccccaaatacaacagtaagaaaatcacaaagggggtctgtaaatgaacatacggatcacccatcaacggaacaaacatcttcaagccaaacaggacgtgaataattcctaatatccccggcaacaaaaacagtgcgcctaattcacggcgaattgaacgccgaattaaattttgtcgcgttcctaatcggtttaacatataatagcgctgtctatccggttggacacccgataaaattttaaacattaaacagcttgccaacattgtcaaaaacgccaatcctaagaagaagcccacaaattctaatccaccaaacatgacattggccacttggtacagtggataagccccgcctaactgttgaatcgacatgtggccaggaaattgattggtttgattttctgcaatttgtttcaaaacacctgcatttttagctaatccggttgtcttcagtaaagttaattgtgatggcttaccctgaattttcagaaaattacggtgagacacaactctgatctgtcttaaagtgtaatttgcttgcagactcaaaaattgctcttgcacccgtgaactagacctcagttgctcactagtagctagtttgaagacaacggcatcagccttaacgcgactcacttgaaaaggtgtttcttgaaactccatttggtcaaaataggcagttgtgccaacaatttttcgcttataagtcacttgctttattaaatctaatttttgaattaattgtttagttttcgcagtttgcttataaacaaccaagtcataagctgaactaccgcttgccatacttgggattaaacgatgatagcccattccaaccgtaattgctcctaaggctaaggcaaaaaggatacttacgacggctagaattctggtataatctcgaatgcgaaagtttaactggcctaatgtaaagctatttaagcccttacctgccaagcgtgagcgtttcaatcccgtaatcaaaatttgaaaaagtgcatgatacaaaaaatacgtgcccaatacgattgtgaccagtgcaattggaattgagagaagttgcaaagtctcaatagccgccattgcccagtaaccaccggctattaaaactaaacctaatccaccttcagcgtaacgccaggccgttaacttgattggtttatctgccaccgtatcagcatggagcaattttaacaccggtcgatgtagcaacttgtgctgattaattaacgaagccataaaaaagatcacaataaagaacgcaaaagtcacaagcaaagccatggtattccaggcagtaaaatgggcaacttcaacgcccaactcgtgcattaataattgagataatccttttgtaagcccaacaccgactacaacacccaagactgtggaaattgccccaatcaataacgtttctaaaaaaattaagaaaccaagtcgtgattttttcccgcctaacatgatgaacaaaccataatcatgttctctcatattcattaggaatgaattagcatacacgatataaacgagggtaataattccaaggagcacagaaccaaattgaaaaacaaacgtcgctaacccaagtgaaatatttcccttgatgaaggcttgattagtggcgattgcttcaaacatataaaaaattgcgcttgaaataatcaatccagaaaaaagcaccaaatagtcccgccaacgatccttaacacttataaaggctaatttaaataacatcgacatcttccccctgatcattaaaggtgccaagtttattcaaaattgtttggtaaaactcagttcgcgtttgactgccagcttcaagttgttcaccaatttggccatccttaatgaacaaaatgcgttcacagtaactagctgaaaacggatcatgggttaccattaatatagaaacttgttcttcatcattaacttgtttcaaagtttccaaaagttctcgggcattttgggaatccaaagctccggttggttcatcggcaaataaaatttgtggtcgtgagattaatcccctcgcggccgcaatccgttgcttttgaccaccagatatttctaccggatatttatcaagtagctgattgatccccagctgactagcaatttgatggacaagttcgttagttttccgctttttaacgccctgcaaagtcaatggtaatccaatattttctgcattcgataaactttccaagagattaaaatcctgaaaaataaagccaatctttttagcccgaaaatccgaaacggcatttcctttcaactgtgtcacatcttgacctgcaataaagacgttacctgccgttggttgatccatcgttgctaaaatattcagcaatgtcgtttttcctgaacccgaagcccccataatgcctacgaattcacctttttttacattaaaattgacgttttgtaaagcagtgtactgtttttcatttttctttccatacacttttgtcacgctttgaacatcaataaccgtttgttctttcacagttgcttcccccatatctgtaaattggttaattacttatgtaactaactatacttggaaagtatttttctgtcaagtacaaaaaagcttttaaacactttcaacctgtttggctgtaaatgtttaaaagctttaaaattcaaagattagtttaacttggctacccgatcatgaatcatttccgcagacttagcgaactttacagtttcttcgtctgtcaaaggtaagtcaaccacagactcaattccgttcttgcccacaatcgctggtaaaccaacgtaagtactatatttttcactataaccagacaccggacaaactaaacgagcatccgacaaaactgcttgtcccaaactgacaccacaagtcgcaattgcagctgaagtaaatcctttaccggaagcaacttcccaagcaccttgtttagcggcatcagctaattgatcaaaatcgaagtctttagcttcaggtaaatcctgaatagcttcaccttttacacgaacacttgaccatgccacaaattggctatttccatgctcacccaaaacataaccttctacgctgcggggatttacatttaatttttcaccaacaacacgttgcatccgcgcggtatccaagaaagttcccgttccaaacactctttgctttgaaaacccagtcaacttctgcaaataactggtaaccgcatcacaaggattcataatgtcgataatcacacccttaaatccagatgccacaattttaggggcgatttctttgacaaccgctgaagtgatcttgaactctgcaaaacgatcgccactgttagttgaaactgcgatatctccagctgagatatataaaatatcaacatccttcaaattgtcgtaattttgagttgtgatttgggtagttgtattcaatcgtgcttgggcatcctgcaggtctaactgctcagcacgtgactttttctgatctttatcaataagtactagtgaatcagcaattccctttgtaaccaaagtatatacaactgtacggccaacgttccctaaaccaataattccaaattttctcattttaacacccttttctcgttattaacttaatcctacccattttctgaaagatggtcaatacataaaaagccattgaaattcaaaacttcaacggccatttacatatcaaaattcgattatttaactggttttacaggtaaaatagcacccttgtaatgtttcttgatccaagattgcgtactctttgattgaagagctttaaccaatttcttgatggctttgttgttcttctcacttggacgaattgcaatgatatttttgtatggtgaattagatttttcaattgccacagattgtgtaattggattcaaaccagattgaaccgcatagttagcattaatcacaaccgcgtcaccttcgccgtttttgtacaattgaggcatcagtttcggctcataactatgtttaaattgaatatgttttggattacttgcaatatcattaaacgttgcacttgtgatatccacaccctttttgatcgtaatcaaaccggcatccttaaagatcgtcaaaattcgaccataatctggtgcattattacttaccaaaacagtcgcattctttggtaaatttttgagatttttatacttcttagagaatacagaaattggttccaagtgaacggcaccggcatcaattaaattacctttgtttttcttattccattgattcaaaaatggaatgtgttggaagtagttcgcatcaatatcaccgttagctaaagctttattaggaagaacgtaatcttgaaagactttaatctttaaattaaccccttcttttttcaactcaggttggacatgttttaaaatttgagcatgtggcactgcagatgccccaactgtaatggttgttgttttggaactggtgcttgatttcttaccacaagacaccaataaaagtgctgttgctgcgactgctaaaaagccaaaaattttattcttcttcatattcaaactcctcctcaaattaaagtactcgtttatcaacttttcgggttgcgaaatccccgagaaattggaaagcaaaaacaatgatcacaataatgactgtggcaactaaagtcaccgtattattactactctcaaatccttcttgataggccaaatttcccagcccaccggcaccaattgcaccggccatagctgtataaccaatcaaagaaatcgttgtaaccgtaattcccgaaatcaacgctggcaaactttctggtaataaaaccttcgtaataatctgccattgactggctcccattgcgttcgaagcctcaagcacaccccgatcaatttcatgaaacgctaattcaaccattcgaccataaaacggagccgcggaaataattaaggatggtaacgccgcaactgggccaatgatcgttcccacgacattcttagtaaatggcaacaacaaaacgattaaaatgataaatggaatagatcgaaacacattgacaaaaagcgcaacaatccagttaataatgcggacaactaaattagtacttccactggtttcaaacaataataatccaataaagtatcccaagatcgcaacggctacaatcgaaacgatggtcatccaaatggtctcccaagttgcgctccacatttgattccagtcaactgtgttaaattcaaagtaacctgtactaccgcccatgttcgatcacctccgtttcgacacgcatagtcttcagatagtctaaagccccgttaatatccccttcatcaccaatcaactgtaagaaaagtgaaccaattgcgccctcatgggtttgatggatatttccttcaataatgctgattcggatcttaggaaatttatgaataatttccgaaacaattggtaaattggcttgattaccatgaaaggtcaattgaataattttgccatttggatattcctttagcaactgttctacaaccacatcggtatcttccggcgacggagcagcctctgagtaaacaaatcgttttgtaattggttgttgtggatgcttaaaaacgtccaaaacttgaccagactcaatgatcttaccaccatccaaaacggcaacatgctcgcaaatctttcgaatcacatgcatttcatgagtaattaaaataatcgtaattcctaatcgcttattgatatccatcaataggtccaatacttcatcggtagtttgtggatcaagtgcactggtagcctcatcagaaagcaaaatttctggatcgtttgccaaggctctcgccacaccaactcgttgtttttgaccaccggataattcagagggataggcatcttctttaccttccaaaccaaccaatttgattaactcttctgccttcttttgacgatcggcttttgaaatcttggcaatttcaaggggaaactcaatattcttacgaacagttcgagaccacaatagattaaaatgttgaaaaatcattccaattttgtggcgcttttttcttaatgcattgcgatccagctctgagatcttagtgccattcacctcaaccacacctgtcgttggagtttctagaccattcagcattctgatcaaagtcgtcttaccagcaccagaatacccaacgattccaaatatttcaccgtcttcaatcttcatgttcacgtctttaattgctgtaacgttacctttttctgtagcgaaggtcttcgaaacatccttaaattctatcaaacgatcaacctcctctttctttttaaccaaacaaaaaagtctttcatcccgttgaaataaatcaactaggacgaaagacttctcttccgtgttaccacccaaattcactaacttttcacaaagtcagccttaacgagtcaaacaactcggacgctataatgggcgcacccagtacttgcttgcagaacgctcacaaatacctcttttatcaagaccatcttcgattgcacttactgtcccatctcaccaaaaggaactctcttaaagtagtaatcaacttactcatcttgttttaatgtttagctattaaatgcagtatactcattcaaattgtgtctgtcaaccacaaatatgagttttttattagaaatctgttttttgaagtgtactgtatgaatcgtggtgaaaccgcatagacataatcaacccaattcctatcatatttccaataagggctgatcccccttgactcacaaatgggagcggaattccagttaaaggcaacaaaccaatgttcattccgatattttcgagaacatgaaataaaatcatcatgattgtccctgtagcaatataagcataaaaagcgttcttcgtatcaaaagtgacacgaatcatttgatacatcaaaagcatgtataacagaactaaaaccacactgccgataaaaccaaagttttcaccgatcacagagaaaatcatatctgactctcggactggcacatagacattcgaaacattgaaaccttttccgaatagttgtcctgacccaattgctttaatactctgccataattgataacctgaatttgtcgtatcagaagatgggtgtagccaggtatcaattcggctaaactgatagctttcaaatccgacgtgagacaaaagactacgtccccaatcactcactaccagcatcaatgtactgctagccaaaaccgttgccgtgacaaatgcaggtactaaaattcgccaagttacgcctgaaacaatgactaatccagcaaaaatagcgataaatactaacatggttccgaagtcgttctgcaaaagtagtaaaacaggaattggcaacgtccataaaatcatttcgccaattaaacgccaatcagatcgcatggtatgacgcttatgctgggcattaaaatccgtcaaaactttagccatcatcaaaatataggccggcttcataacttctgaaggctgaaaagtgaatccacgaaaggcaaaccaactcttagccccacttgctgcataacttctgctgtaaaatatcaaaactgcaactagtagaaaaataccaaaccagtaagcatacggcgctatcttccaaagttgttcggaatcgaactgcatgatgacaacaaccgcagcaacccctaatacataccacactaactgcgaagctacttgatggatcacgcttacactgcccgtatcatgtgccgcagcaacataaatcgaggcaagtccaattaaggccaacattaacaccgaaaaaattattccataatcaatgcgagaatcgccttcccgtcttctaactcgtgaatcgttattcaaactaaagatccttccttaacttaaactgcgctttattgatgaagattgtattcttgcaaaagccattcaacagcatcatccgtggatttagctgtaaagtctccgcccccaattagatgagtcgcaaattctttatcctgtggtgtgatttcgccgattaaatttttagcaataaaaagttgttgaatcgtttgcccatcaacttctttttcttcaatttgtaccttaacactttgctgtttcttagacataatttcctccatacaggttaatttaatattttttcatcaggatgcggattacgtttcaaagtaaaataatccggcaccggatcataaccacccttaacaaacggattacagcgtaaaatacgcgcagtccccattaaggtacctttcaatgccccgtgcttcttaagggctcccaacatataattagagcatgtcggataataccgacaacttggtggaaaaagtggtgatataaacttttgatatccacgtactagcatcaaaaagaattttttcaattgtgtccacctctcaaaaatatccaatctaacagcctattatagcacaccctaaattctctctaaagcccgaatctagctgatattaacctgtaaaatgaatagaaacgacggtcaactaagtaacgccttccacctcacgttattaatcgaccgtcattgattttttattttttatcaaaaaattaatttttgaccgttaaagttgtattcgtaccagagacacgtttaatttgagcacctaaagcactcaacttaccatgaaagttatagtaacctcgatctaaatacttcaaattagtgacctgtgtatacccctttgccactaaacctgcaataaccaaggccgcaccagctctcaaatccgtagcagccacttcagcaccattaaaatcagttgggccattcataatgacggaagaaccttccactctatactgggcattcattcgacgtaattcctctaaatgcataaaccgattttcaaacacagtttcagttagtgtacttgtgccttgtgccaataactgcaataccgacatttggggttgcatatccgttgggaacccaggatgcggtaatgttttaatcgaaaccggcaatagttttttaggcccaacgatacgaatcccctcatctttttcaaagatatggacacccatttcacgcattttagaaattaatggtttgttgtgttctgaaattgcatcttgaattaagacatccccctgggtagcagcagccgccaccatgaaagtaccggcttcaatccgatcctgaacaacagcatggcttgttccgtgcaattgatgcacaccaataattcggattgtttccgttcctgctccagtgacatgggcgcccattttatttaagatcatggccaagtcaacaatttctggctcgcaagcggcattttcaatgattgtgtttccatgcgccaatgttgccgccatcataatattttgagttgcgcctacacttggaaagtctaaatagatgttagtcccgattaattttcttgcactagcttctatgtatccatcatgctgcgtaatatgagctcccaatgctgccagtccttttaaatgtaaatcaactggtcgagaaccgattgcacaaccaccaggcattgccaccttggcatgtccagttcttgctagtaacggacccattacaacgattgaagctctcattttagacacgtactcaaatggggcttcggtagagactttcttagttgcgtccatccaaatctcatgttgggcttcatcaaactcaacatcgacattcaaaaaacgcaacacgttattcatcgtataaacatcagataaaattggtacattacttaactcaacttgaccttcactagctaaaattcctgctgccaaaatcggcagaacagcatttttggcgccttcaatcttgactacacctttgagtcgattgccgcccttaacaataatcttatccacgaacgaaacctccactattttagtaagtaacttaaatttctaatattattaattaattcgagaaagaatgagccacccatgtaccctagaccaattgacagtaaaacaatcaatgttttaaattggtttggatcagaaacatgtaaaatacgctccagatggataccttgaatcgcccaaaaagaaatgaaaataaaaaagaagtaacaaattaacgttaataaagcttgaattcccaataaattcataaaatcctcttcaatctattatttattacaatagtatcatatccatactaaaaatacgcgtttaactctcattttaataaattaataatcataaaaaaagagctccacaaccaaacggttatgaaactctttaaatgtgaattaatgttttgcaacattaattcgattaattgcacgacgtaatgaaatctgtgcacgacgtaactcagagttgtcatgagcatcatgagcttttcgaatagtttcttgagctcgttgacgcgcattttcagcacgatttacatcaatatcagattcattttctgcagtatcagcaacgattgtggctgtattatccgaaaactctacaaagccaccattgaccgcaactgcatcttctcttttaccagaatcatcatgtttgattcgcacttcatcaatcgatagtgacgcaataatagggacatggttaggcataattccaagctggccagcttgtgtctttactaccagcatgctggaagttccatcataaacttgaccatcaggagtcacgatactaacggttaatactgatttatcagccaattagaattcccccttatttacttgcagcactagttaacttcttcgccttttcaacaacttcatcaatattcccgacctgacggaaagcatcttcaggtaaatcatcgtacttaccttcaagaatttctttgaaaccttttactgtttcttcaacaggaacataagaacctggttgaccagtaaactgttccgcaactgagaagttttgtgataggaagaattggattcgacgagcacgagcgacaatcgttttttcttcgtcagataattcatccattcctaaaatagaaatgatatcttgcaactcacgatagcgttgcaacacatgctgaacatctgttgccactttgtaatgttcctcaccaacgacagatggatccaacgcacttgaagtagaagccaacggatcaacagcgggataaattccttgttgcgttaagctacgttccaagttagttgtggcatccaaatgggcgaaggttgcggcaggggcgggatcagtataatcatcggcaggcacataaacggcctgaatcgaagtaattgatcccttcttggttgaagtaattcgttcctgcaactgacccatttcagtggccagtgttggttgataaccaacggcagaaggaatacggccaagcaatgcggatacttcagaaccggcctgtgtgaatcggaaaatgttatcgataaacaataacacatcttgtccttcaacatcacggaaatattccgccaatgttaaaccagtcaaagcaacccgcatacgtgcaccaggcggctcgttcatctgaccatacaccatggcagtcttttcaagaacacccgatgccttcatttcaaaatacaagtcatttccttcacgagtacgttcaccaacacccgtaaatacagaaataccattgtgttcttgtgcaatattatgaattaattcctgaattaaaacagttttaccaacaccggcaccaccgaatagtccaaccttgccaccacggatatatggagccagcaaatcaataactttaattcctgtttccaaaatttccatactagggtttaggtcatcatacttaggtggatcccgatgaataggattacgttttacttcgggtccaaatttttcaccattatcaattgtttctccaaggacgttgaaaacccgacctaatgttttatcaccaactggaactgtgattgaagaaccagtatcttcaacttccaatccacgttgtaaaccatcagtaccatccatagcaattgttcgcacaacgccgtctccaagttcaagagcgacttcagcaaccaaaatactgccgtctggtttcttgacgtttaaagcattattaatatcaggtaaattaccatccagaggaaattcaacatcaacaacaggtccgataacttggacaactttaccagtactcattattagttaattcctcccatctaaatttattcttgtgcagcctgaccaccggtaatttcggtgatttcagtggtaatcgcactttgtcgtgcacggttatattgcaattgaagcgatgaaattaaatctttagcattgtcagaagcagtttgcatagctgtcgaacttgaagcatgctcagcggtcttagcatccagaattgcaccataaacaaggctttctgcatactgaggtaaaatagcctgtagtaacgcagcttctgaaggctctgtctcatattctggcattaattctttttttccctgctcttttttctcatcttgacttttcactaaagcatcactaattggcaacattttaattgaatgaaatctatttgttaagcgatttacaaaatggttgtaacaaacataaagttcatcaaaaacttgattagagtacattgacgttgcagtttgaacgatttcacgtacttcgttaaaagtaggaacatcactcacaccacgaaattcataagccacgttcatatcacgtgctttataaaagtctgcgccagttcctccgacagccaaaataacactgtcttcggccgaatgacctgtggattgaatgaaatcctcagtttgtttgaggaccgagctattatagctaccaactaacccacgatcagatgtaataaccaagaacccaacttttttgactggtcgttgttttagcaaatctgttgctgaaatggtactttccgtagtgtcatcgcttttttcacttccagctgcattttcactaattaaatgtgattttgcaaggtgagccacaatactttcaactttttcagcataaacgcgatacccaaaagtatgtttttgaatttgattcagttttgcggtcgaaaccatttgcatcgcagtggtaatttgactggtcttcttagtggagtcaattcgtctgagaacgtcttgttctgaagctgccattttttctcaccactttctgtcaattaaagcattgttttatttagaagcacttgcgtcttctacttttgttggttgaaattgatctgcaaattcttgaattgcagcatccattttgtcggtatctggtaaatcgcccgttttgcggataacatctaacaaatcgtcgtgtgaaccatcgatatattcgattaattcatcttggaaacgcaaaatatcatcaatagcaattttatctaagaaaccatgagtcaacgcatacaaaattaaaacttgatgctcaacagcaagcggtttgtgcaatggttgtttcaaaacttcaacagttcgacttccacgtgctaacttcgccttagtggcatcatccaaatcagaaccaaattgcgcaaatgattccaattcacgataagatgctaagtccaaacgcaatgtcccggctacccgtttcatagctttgatctgtgcatctccaccaacacgggatacagaagaacccgcatcaattgcaggacgagtaccagaatagaataggtcactatccaagaaaatttgaccatcagtaattgaaataacattggttggaatataagcggcaatatcgcccgctttagtttcaacgaatggcaaagccgtcattgaacctgcacccagtttgtcattcaattttgctgctcgttctagtaaacgtgaatgtgtgtagaagatatcaccaggataagcttcacgaccaggcggacgtctcaaaatcaaggaaagttcacgataagcatcagcttgttttgaaagatcatcatacacgatcaaaacatgcttaccattgaacataaattcctcacccattgctgcaccagcatatggtgccaagtagagcattggagctggttctgatggaccggcactcaaaacaattgtgtagtccattgcaccaaacttttcgagcgtatcaacctgggtacgcacagttgattccttttgaccaattgcaacatagatacagataatattttgattcttttgattcaaaattgtatcaattgctaaagatgttttacctgttttacggtcaccaatgattaactcacgttgaccacgaccaattggaaccaacgaatcaatcgccttaatccctgtttgaaggggttcgctaactgattgtcgttccataacgccaggagctttacgttcaactggacgtgtatgatctgttttaatttcgcctttaccatcgattggttgaccaagtgtattgacaacccgtccgattaaggcttctccaactggaacttccatgattcgtccagttctcttaactgtgtcaccttcacgaatatcatcatagttaccaagaataacaattccgacatcgtttgattcaaggttttgaaccattccgtaaacaccgttagagaattctagaagttcaccagcaagagcattatctaagccatgagcacgggcgataccatcaccgacatatgtaacggtacctgtttcttcgacattaagctcgtcttgatagccttctaattgttgtttaattagagcactgatttcctcagatttaatgctcataaaagtttcacctctttacaaaatctcatttaagtaacatttgcttgatcttagccatcttagaactaatactgccatcataaactaaaccatttgatttcaacacagccccaccaataatacttggatcaagccggctatttatgatcactttttgtgctccgattcttttagcaaatccatctgctaatcgtttcttttgatccgaattgatttcaaccgcagtcgacaattccgcataagtaatgtggttgtaagcattgtaaagaacagtaaactgatccacaatgtccaccatattacttatccgaccataatcataaaccatttgaatcaagtttttgacgtaaacagccgcatccttctttagatccacaataattgttgatttttgctcatcagttaaacgaacatcatctaaaatttggtctaaatccgaaacttcactaaaaacttgcttaatctgttgtaaatcctcataaactggttcaagttggttcttttcaacagctaaatcaaaaagggcttttgaatatcgtttggcaattgtcatcttatctagactcattttgcttccccaacccttcaatgtaagaatcaattaactgtttttgatcctgcgcgttcaattctttttgaatgatcttagaagcaatttcaatagataaactagccacatcattctgagcacccttcagtgcatcttttcgctcttgttcaatgtccttttgagcattttgcttgagtgtttgtgcttcttgttgggcacttgcaacgatttgttcacgctgttttgtcccattatccttcgcgttgcttacaatcgtggaggcttcggcatgagaattcttcaacgcttcttctcgttgttcagctaacttttctgcatctgtgcgtgatttctttgcagaatcgatatcgttagaaattcgatctgcccgttccttcatcatcttagtaactggtccccatgcgacaactttaattacccacatgagaataacaaagacgatggcatagaacaacatatcaccaagatacagcgaatttgaagcacccaacattaaatgtgagagcatctattgacacctccttctaccctattatttgtttgcttgtgtgacaataaactacttgttcatgactaacaatgccacaacgaaagcgataataggcatagcttcaacaagaccaacaccaataaacatagttgttcttaattgaccagataattctggttggcgtgccattccttcaagtgtttttgcaataacaagggcatcaccgataccaccaccgatagcggctccggacataataattcctgctgcaatagctcccatagttttaaatcctcctaaaatattaattattcctcagtctgaatctgttgagaaatgtaaactgaagtcaaagtgacgaaaacatacgcttgaatactacctaagaataatgaaaatccttgccaaataaatgcaattggtacggcaacaattgtcataccaacaccaccagaaaaggccatttctccgataattttcagcaacaattctcctgaaaagataaccccgtaaatacgtaaacctaacgtaaggaagtcaatcaattcggtaaaaacactaattggtagccagaacttaaacggcgtcaaatatgattccttaaagtactttttgaatccgagctttttgactccagaaaaatgtgccaacatcaacgtcatcaacgagaatgtcagcgtcacaattggatctgaagttggactccgcacatacgttacaccattccaaccaatctgtaggaataacccaagttggttagatacaaaaatgaataagaacaaagtaaatgcatataaaccaaagttcggtgcatcaccatttgtcactgagcctcgaacaatattattcgtaaaatcaattaaccactctaaaacattttgttttccagttggttttaattttagatttcttgaaaacgcgaaaactattacaactacgataattgccgcaagcaatcctgaaataatattggtcgtattaaaagtaagccccaaaaattggaaagtagaaacagagtctccactcacagaagatcacctcttttcatagccttagtgaattattgaagatttgcaggtcaactaccctaaaacgtcaacaattatataaaaatagagcgtaatgcctattcaaaatacaaataaaataataccaccaatttgggaaaaacacaaaaaaaggaggatatttttcacttttaaaaaggagtcatcatgcccgtgaaatcaacattttcaataaagcgcttaccgtttaggtagtcctaaacagttctccttcactttttaaaaataatcggagatattaaaaaagaagcaaaaaaatcgacatccgttttataaaaacaacatgcccattttttgctcttcttttgaaaaactatttagctaaacctacaagttactttgtaccaaacaaacgatcgccagcatcccctagtccaggaacaatatagccatcttcattcaatgattcatccaaagctgctgtatagatatcaacatcaggatgagcttcttgtaaggcttttacaccctctggagctgctaccaaacacactaatcgcagatcttttgcgccgcgctttttcaaagcatccattgccataattgctgaaccaccagttgctaacattggatcgacaacaaaaatttgtcgttcgctaatatcacttggtaatttaacaaaatattcaactggctttaaagtcttttcatctcggtacataccgatatgaccaaccttagctgcaggaattaattcaagcattccatcaaccatacctaatccagcccgaagaatcggaacgatagctacttttttacccgaaagtgtttttttggttgtccaaccaattggcgtctcaactttaacatcctctaatggcatatcgcgtgaaacttcgtaagccatgagctcagagatttcattaacaacttctctaaatacctttgtaccacaattcttatctctaataattgttaatttgtgctgaatcaacggatggtcaagaacttggaacttacccataaatcacactctcccttcaatatctctatcaattgtagctaacttgacgcaaaaaaactaggggtaattcaattaatttacatcaattggatgttttgctgttaatgcaaagacttgttgttttaaatcagctaatttttcaacagaattatgattttctagtgctgataaaataattttagcaacttgttcacaatcatcttcactgaatccacgagtcgtaattgctggtgttccaattcttaacccactcgttttaaacggacttcgcttttcatttggaattgcttccttattagttgtaataaaaatggaatccaataaatcttgcacttcttgaccatttaattcggtttttgttaaatcaagagtcagcaaatgattgtcagttccacccgaaactacgcgcaccaaatcggattcgttaaaggtttctgccatcttattggcattatccttgacctgttgcatgtacgttttgaattctggttgtaaatcctcgccaaaggcaactgctttagcggcgatcacgtgctctaatgggccgccctgcgtcattggaaagacggcagaattaatttttttggcatacttttcttgggataaaatcattcctccacgagggcctcgtaacgttttatgcgtggtggtcgtgaccacgtccgcaatgcccactggtgatgggtgcaagccagttgccaccagtccggcaatatgtgccatatcaaccattaaataggcaccaacttcatcagcaatttctctaaacgcttgccaatcaataatacgactatacgctgaagcgcccgccacaataatctgtggtttttcggcaattgcaatcttgcgaatgtcttcgtagttcagtcgttctgtttttaaatcaataccataactagctgatttataaaactttccactaaaactaactttcgcaccgtgagtcaaatgaccaccagcgtttaagtccatacccagaattttgtctcccggtttgataaatgcggcatacgctgccgcattggcctgcgaaccagagtgcggctgcacatttgcatattcagcgccgaataattttttggctcgatcaattgctaattgctctacttggtcgatatattggcaaccgccatagtaacgttttcccggataaccttctgcgtacttattggtcaaaacagtcccctgtgcttcacgaactgctttcgatacaatattttcagatgcaattaattcaatattatgctgttggcgattttgctcacccgcaattgcatcccatagttcagggtcttcttttttgtaatccattaaaacgcctcctatttattaggtgtttgaaagtattgttgtcctgccgattttcctagacgattcatgtaggcctcgcctagccctattctatcaaattcttgagccaaaatatacgtcaccgaactttctaaatcaaaatgccgtaatccagcaaataaattgtgactagctgaatggacatcttcacctaatgaaaaccattctgcatttgttggaatgagattctctttttttacctgttcggtagtcattaccccaaccggactattttgctgggctgcccagttcatggcggctggccactggtcatcagccacaatcaaaacttgtgcgttgggcgcataatgtttatatttcatccctggagctttaggaacttcatttttaccgaccttatgatgatcagattgaacagtaccgataactttagctaactgcgcttcactaaccgcgccaggtcttaaaatacttggcacctcaccagacatatcaataacggttgattccaccccaatttgggttggtccatcatccagaattcccgcaattttgccatgcaaatcatgatacacatgtttagcctctgttggactaggttttcctgaagtatttgcagaaggccccacaattggcaccccagcctgacgaattaagtcgagcgttgcttcgttatgtgggttccggaaggccgcggtttccaacccgcctgtcacactctttgagagcgcatctggtttgagtttcaaaataatggtcaacggtcctggccaaaatgtcttcattaataaacgggttttttcagacaagggttgcgcatacttttcaacggtcgtaatatccgccacatgaacaataagcgggttatcactcggtcgtccttttgccacatacacctgtttgactgctgcttcattcgtcgcatcagcccccaagccataaacggtttcagttggaaaagacaccaattgcccagcctgaatttctttcgctgcttccttgattgtatctgcatgatatattttcgtttccaaattatgacttcccttcaccatcaagcgttacgcacatcattcgatcatgacctgtaacgtcttttttaaaattcacttgatacttatgatccgccgctgtaaataaattcgctaattcttctttttgttggtatccaaattcgcaatataaacggccattctcatttagatgatcgctgacttgttgactgaattgtcggtaaatggccagtccctgttcttttgcaaacaaagcttgatgcggttcgtattgaatcacactttgatccatagcctttttttctgactctgcaatatacggcggattagagacaatgatgtcaaaacgtttgttaccaaaattttcaaacaagtcactttggataagtgggatttccaccttttgtaaggttacatttttctgagccacctgtatggcatccgctgaaatatcagaacccgtcacttgccaatttggtcgctgtttttttagtgcaattgcaatggctcctgaaccggtgccgatatccaaaatcgtatgccttgtttcatcattgtcatttaatacccattcaaccaattcttcagtttcaaaccggggaatcaagacgcgagaatccacaaataagttatttccgtaaaaagtagcttgctgcgtcagatactgaacaggaattccatcagcatactggcgcacatttttttgataagcagtccaagtcgacggcgtcatcacatttcgataatgtaaaactaactgtgtattgttccaatgcatcatgttggctaagagcaactttgccccactttcatcaatgccagcctgagtagtgggcttgatatacaaaaaagcccatttaagggcctctaaataggtggggttactcatttcgaagttgctccatcttctttgcttgatcatctaaaatcaaagcatcaattatttcatctaactcaccgttcataatccgatccagtttgtttaaactcaacccaattcggtgatctgtgacccggttttgtggatagttataagttcgaattcgttccgaacgatcacccgttccgaccgcgctctttcgttcagcatcataagcatcttgttcacgcgtttgatagtaatcgtaaacccgcgctttcaaaatttgcatcgctttaactcggttttgttgctgagaacgttcatcttgcatggcaaccacaatcccagttggtaaatgggtcattcgcacagctgatgaagttttgttaatatgctgaccaccagcaccagatgaccgatagacatcggttcgaatatcttttggatcaatatcaatgtcaacatcttcagcttctggcataacacccactgtagcagttgaagtatggactcgacccgccgattctgtcaccggcacccgttggacacgatgagcaccattttcatacttgagtttggaatagacccgatcaccggaaatcatcaacacaatttctttaaagccaccaacttcagtcgcgttctcgtccacaatttgaactttccatccttgattttcagcgtatcgtgaatacatgttgaaaagatccgccgcaaataaactagcttcatccccaccagcagcaccatgaatttccataatgatatttttgtcatcattagggtccgttggtaacatcagtactttaatttgttcttcaatatcatcgcgttgacttctcaaactacttaattcagatttaactaactcatccatttctggatctagtttttcacgttgcatttcttcatcatcagcaatttgagcaatcacttttttatactctcggaactttgcgactgtttcgcgaatacttgcttcttccttagacaactcagtaaatttctgagaatcagaaattacatcgggatccgctaaaagttcatttaactcatcatagcgatcctcaactgcctgaagtttatcaataaaatcattcattaactatctttcctcatttcatccaaaggagggttcacatagtgacgtcggcaaactggatagtaggcctcgttgccaccgatctgaacttgttctccttcatatactggtttgccgtttgcaaaacgtaaattcataattgctttatgtttgcagaaccaacaaatggttttcatctcttcgattttatccgcataaattaataagtattttgaaccttcaaataattcattacgaaaatcatttttaagtccaaatgtcattacagggatatttaaatcatcaacgatttttgcaagctcaataatgtgatgcttctttaaaaattgagcctcgtcaattaatacgcaagccgcgtttggattgagctccaaaacgcgtttataaacatcggtatcatcaaaaattggttccgcagtgcggtgcaaacctatgcggctggcaatttcaccaacattttctcgtgtatcaattccactggtcatcaaaacaacagatttatgttgctcttcataattatgagcaaccttcaatatttcaatcgatttaccactattcattgcgccatagtgaaagaataactgtgccaaagtagtttctccctttgtatttacttcctatttagtatagccgataaccagaaaaatttcatctttgatcataagccagaatcactttgaaaggttctttttccggataactttcttttttgcgcgctagggcttaaaattaacatttaggatttagggtaatacacccttttaacaatttgatggaggagtcttatgtcactcaaaagctcacttgccattacgactggaaaatcagcctattggtttttgcataaatttcgaaacggaggaagctcgcttcccggaaaactaacaactaaaattgatcccgatattttaaaagtgttgggacaaaattacgacgtcattgtgattaccggaactaacggtaaaactttaacaacggcacttactgtaaaagttttaaatcaaaaatttgatcatgttttaacgaatccaagtggctccaacatggaacaaggcattgtgaccacatttttaaccgctaaaagatctaaaaacggccgtcaaattgccgttttggaggttgacgaagccaacgtcattatggtgaccaagtatatcaagcccgtagcgtttgtgttgaccaatattttccgtgaccagatggatcgctacggtgaaatttacacgacttataaaaaaattctagatggcattgctctggtacctgaagcaacgatcattgctaatggcgacgcttctatttttaattcaaaagaactgcccaatcccattcagtattatggattcaacaatcaaagtgaccacgacgttactgctgatgtaaatacggacggcattttgtgccctgtgtgccagcatgtcttgcactataactttatcgtttacagtaatttaggaaaatatttctgtcctaattgtggctttaaacgccccgcattgaaatacgaattaactagtgttgatcaattgacccctgcaacttcagcatttactatcgatggcacttcgtttaatttacacattggtggcctttacaacgtgtataacgcactagctgcgtattctgttggtaaattcatgggcgtcacagatgatgaaattgccaccgcattaaacgatccagacgaacgcgtttttgggcgtcaagaacaaattcaggttggcgacaaagaaattaccatcgtcttggtcaaaaatccagttgggttaaaccaagtgatcgacatggtaggcactgaaacacaacctttttcgttagttgggttactaaatgccaattatgcggacggaattgacacaagttggatttgggatggcgagtttgaaaagcttcctaagatgaatattaaacaattcatgacaggtggcgagcggtacaaagatatcaccttccgtttgaaagtggccggtgtaacggacgataacttatggattgaacctaatcttcatgatgcggtcgaccaattaaaagatttgccaacaaaacgggtttatgtttttgcaacctacactgctatgcttcaattacgcaaacagctagctgacgatggctatattaaggagggaatttaattgaaatattccttaaacgttgctcacttatacggtaatctcctcaatacctatggtgataatggcaatttactagcactcaaatattacgccaaacaaatggacacggatctaaccgttaaagtcatcagtttagatgacgactttaaggcagccaattttgatttagtctttttcggtggcggtcaagattacgaacaattaatcgtttcaaaagacattccttcaaaaaaagaagaactaaccaaatatatcaacgatggtggaccaatgttagctatctgtggcggttatcagctccttggccattactatattggtgcggacggcgaaaagattccgggtattggggctttagatcattacacccttagtcaggatcacaaccgcttcattggcaacattttaattaaaaacaaacagacgcaagaagaatatcatggttttgaaaaccataatggcatgaccttcttgggaaaaggtgaaaaaccactaggtgttgttgaaagtggtcacggaaataatgggaaagacaaaactgaaggcgtcatttacaaaaacgtctatggttcttatttccatggcccaatcttgacgcgaaacggatctttagcaaaacacctgttaatcactgcccttgaacgaaaatatccagatgccgatttaagccaacaaaaagccttaaaaattccagaaactttttaaacaaaataacggtcaaccacgaattcttacaattcatggctggccgttatttagttagttttatgcttcgcccggttcgcttgcaatgatctgtaagtcaccagttaaagtccactctttaacctgatatggcaagataaaatgaacacccttcttgatatcataactctttccgtcaacttcaatgtgaccttcaccttttaaaacagaaaccaatgtgtaaggagcggctcctcgtttaaacgttgcggtaccattctttagcaaccattgataaacagaaaaatgtggtgaaacaggtggctttacataagttgtaacttctgcatcaccaaccgttgttttttcaacgttgagttttggatcttcatgagggaccgttatcacgtcaattgactgtttcaaatgtagttcacgctttttgccagtctttttatccacacgatcaaaatcgtacaaacgataagtggtatcactactctgttgggtttcaagtaccataatgcccttgcctaacgcatgaatcatgccacttggaacataatagaaatcgcctgctttaactggaacccggcggaataatttatcccattcgccatgattaatccagtctgctaattcttcatgattcttcgcattatgcccataatacaattcggcaccaggttctgcagaaatgacgtaccagcattctgttttgcccaattcatgttcatgttctgctgcataggcatcatttggatgaacttggacggacagattatcgttagcatccaagattttagtcagtaaaggaaaaacgtcaccctttgcattgccaaacgcttcacgatgttgtgcccaaacctgatccaaagttaagcctttgtatggtccattaatcacttctgccggaccatgtggatgagccgaaattgcccaacactcaccagtttgatcactaggaattttatatccaaattcagttgctaatttattgccaccccagattttttcatgaaatactggagccaaaaataatggttcactcaaaacgatctctcctttcgctactacagagaatagtttaccataaaaccgaagcgctttcagtaatgttttggaaatgtatatacaaattttcaattgtgtccatttccaatcaagctcacggtttaactagccttttacactaccctgaccatccttcaaaaacgcctcaatcacagcctgtcggtaagtaaagtaaatttgattgtcagcggtaggatggacccgattagagagaaaaactagcgcttgttgccgagtcgtatcaactaataacatggttcctgtaaaaccactatgctttaacacccaatgatcctcaccgttatcagtttgcttaattaatccccagccaaaagaacggattaaatcaggattagcggtttgattttcaaataactggtttaccgtttgcttcttcaaaactgaagggttagtttccggatgaaggagccaggtaacatactttgttaaatcacccagcgttgaaaaaagacctgccgatccacaatgagcacctaaaatttgcgctttaggatcatgaactgtgcctcgaatcaaacccgttttggctgtccattctgtgggcacacaaattaacggatccggcgcaaatgtagaatgcgttaatttcaacggcgtcaatacccgctcagtaatcgccacttggacaggcgtatgcaaaacatgttcaataatcaacccgagaaaaatataatttaagtcagaataaaccaccttctgattaaaatccggcccaatttcaagtgtaaataacgcttgtaatagctctcttgtgcttaattcattgcgatgtggaatataacccgtgatcccagaagtgtgtgtcaataagtgccgaatggtaacgtgggcgtcaaagaaattgggcagaattttgaccacttgctgatcatatgaaagttgcccttcttcaactagttgactaatcaaaatttctgtgccaacaatcttagttaacgatgccacatcgtaggtcatcccatcttgcagctgaaaatgtttcggtttaacttctgaatcccccattacctttttgataacttgttcatgatcaataatggcataggaaatcccaggcacgatcctttgtgaaactaattttttaatttgtttttctgtattttggtagggttcgctcatttttgaaatctccagtcattaatctaaaaataccatcattcaataattgtctcacttttagactgagacgaactacgaataatggtatttttatctttaaatttaaggtttaaataacttcattgccagagaattggctattatacaaatcagcgtaaaacccattttgttccatcaagctatcatggttcccagtttcaacgatttgaccgtggttgaccaccacaatattttgtgcattgcgaatcgtagaaagtcgatgagcaaccacaaaactagttcggttcttcaacaatttattcatcgcatgttgaatcagaacttcggtccgggtatcaacagaacttgtcgcttcatccaaaatcaatactttgggatctgccaagaaggcccgggcaatggttaacaactgtcgttgaccttgcgaaatattacttgcagattcattcaaaattgtgtcataaccttgaggaagctgacgaacaaaggtatctgcatgggctgccttagcggcttcaaccatatcttcatctgtggcatcttcacgaccatacttgatgttctcgcggatggttccggtaaacagccaagtatcctgaagcaccattgcaaactgtgaacgtaactctgctcgacttaaattacgggtatcaaccccatctaatttaatggaaccatctttaatatcataaaaacgttcaagtaagttaatgatcgtggttttcccggcaccagtaggaccaacaattgcgaccatttcaccagaattaacattcaaattgaagtcttgaattaatggtgtgtcttcaacataacggaagtccacatgatcaaacataacttctgctgctggattcttcacatctggaatttctacatgtgtttctcccatttcaggttcatctaaaacagcgaaaacccgctcggcagaggcaatcgtcatttgaattgtgttcgtcaagttggcaatttgggtaatcggttgtgaaaattgctgagtatattgaaggaatgcctgaacgttacctaaagtaatttgaccatgggcaacttcaattccacccacaacagccacaaagacataacccaagtttttgataaagttcatcaacggcataatcaagcctgatacaaattgggctttccatgcataacctaaatacttgtcattttcctttttaaaatcttgaatggctttatcttcatgattaaaactcttaatgactgtatgtcccgaatacgtttcttcaatctgatcattcaataaacctaaatgtttttgttgaccggcaaaaaacttctgtgattttggggcaacaaacgccaccacaatcaagctcaaaggaacggtcaacacagcaatcaaagttagtttccaactaatagtaagcatcatgtataaaacaccaacaaactgcaagacactagtcactaattgcgtcaaactttgttgtaaggttccagaaatattatccatatcattggacatccgactcataacatcaccgtttgagtgcgtatcataataggaaactggtacccgttgcattttttctttgaaatcttttcgcatctggaacacggctcgttgtgaaacctgagtcatgatggcttgttgcgcgaaactaaatagagctgacaaaccatacaaaattccgacggtcgttaaaatatgcacaatttttgtgaagttaattggtaacgtatgaaggccgataccggctttcatttgcgcagaacccttcattaccccagcgaaaatttgggttgtcgcttcacctaagattttaggtgctctgatttgtaagatcaccgaagccgccgctaaaatcagtaccaggacaaccagcaccatccaaggagagagatatcgtaataaccgccaagttgttttccaaaaatgttgtggcttttcagtaggcattcccatacccatgccatgaccactatgaccgccagttcgttgtggtcgcttttcactatttttagccatttacttgatctcccttcttgatttgtgagtcaataatttcccgataagtctcattattggcctttaattcttgatgcgtaccttgaccaacaagcttgccatcatcgataactaaaattagatcggcatcagcaacagtggcaattcgttgcgccacaatgacaaccacactcttttgaacttgttcatcttcacgtaaggcatgccgtaattcagcatccgttttgaaatctagtgcagaaaatgaatcatcaaaaacgtaaactggtgcttgtttgaccaaagttcgggcaatggttaatcgttgtttttgaccacctgaaaagttgtccccaccttgttctacccaagcgtctaacccatcttcatctttatgaataaattcagttgcttgcgcaatttccattgcacgccaaatttgatcatcagttgcgtccggattgccaaatttcatattctcacgaattgtgccccggaacaaaactgatttttgttgtgcaagtgaaacctgcgcatgcacgtctttttggctcatggtttttacatcaattccgtttatcaaaacttttcctttttcaggatcaaagaaccggggaattaagctaatcaacgttgactttcctgaaccagttcccccaataatggcaactgtctggccagcgtgggcttcaaaatttgcaccatcaatagccagtttttcagcccctttataacggaaatcgacatgatcaaattttaaagaagctgttttttcagtcgcatcaactgaaactggttcagcaggatctttaacgctgtttttcatttcaataacttcattgattcgttttgcagaagcagaagcccgaggaatgaaaacaaaaaccattgaaagcatcataaaactcatcaagatctgagcagcatacgtcataaacgcaaccaaattaccaacttgcatcgtttggttggcaatcaattttgcaccataccagatgattcccatgttggttccactcatgattaaagtcataattggaaacataaaagaaacaatcgtgaaaactttaatcgctgtttgcgtgtaatctttgttggcccctctaaaacgatcctgttcaaatttatcccgattaaacgcccgaataacccgcacaccggttaatccttctcggaaaaccaggttaattcggtcaatttttttctgcattccttgaaagagtgggactgcaaaaaacataatgatcccaacaaaaactgccaaaactggcaaggaaaccaaaaagacaaccgttaattctggttgtttgctataagccataaaaccagcgccaatcaacataattggtgattgcagcatcatccgtaaaatcataaccatcacattttggatttggatcacgtcattagtagttcgagtaattaatgatgcatccccgaactgttcaaattcatgattagacaaaaaagaaacctttttgaaaagtgcatcacggattttactccccatgcgttgagattgcgtagcagcaaaatacacatttacgcctgacgccagcacgccaagtaaagaaattgccaacattttgtatcctgaattccagatatacgaaatatcacttttggcaactccgttattaatgatgtctgatgtaatatttggtaaccataaatcacacatcacctgtacgattaagaataaggtaccaataccaactgcccaccaggctaagtatcgtcgtgataatttaaacatttaaccaagctccttttttgattttagtgcgccgttcgcaatccagttcaatgtcattgaaaattctgctttgatatcctcaagactttctggtgaatttgtcttttgagagtgaaagtaatgcccaattgtatgtaccaacaccataaaaataagcctttgtaatgcctttaaatctgcatcactagtaaccttcaaactggttcgatcaacggagcggctaatttcatcctccgtatcccgcattgctttgaaaaatggataattggcccgatctttaccaaaccggttagagttctgtgcatgttgaaaattggttgccacatcgtttttaaaaatatcagcgttaggtccttcaacaacctcttcaaccgcataatcaaagaaatgagtcattgaaacaaacagatcacccttagtttctttgattaagctcaataaatgctgttccatattattcactaatgtacccagataatagaaatacaaatcttccttatcttcaaagtactgatagaagctaccgcgtggaatttgggcatcggcaacaatggcactgaccgatacttcaggtaacggtgcacgtgaaaattcatgttgcgcggcccgcatcaatcgagcccttttggcttcatttaaattaaaaaatgtggcttttggcatttcttcctcctcaaaatgacacactgtcataattgatgattatacgcttaatctatgcatttgcaagacgaatttattgactcgatttttcacttttttgtcatttctttgtcaaaaacctaaccttttcaatcacaaaattaaaaaacaccactaaaaaatacttagtagcgtctttctgtataaaaaacaaaattctataaataaatttacttaacggttacttgctcagttgactcaatccttccttcaacaatgtgtaactgcgtgtccgcaagttttttcatatcttcagccacgtgcgttgcaaccacaataagttttccttcatctctcagtttgcgtaacaacttaatacatttactaacactctccgtatctaggccgtttgttggttcatctaaaagaataattttttgatcttcaaaaactgcttgtgcaatatttaatttttgcctcattcctagtgaaaaatctttcacaattggtttgtgaatgttctcttctaaaccaactgcctttaaagcattctcaatatcttcatcgtttgcgacatgctgaattttacctaaaattttcaaattttcaaaggctgaatattgaggtaataaactcatattttcgataaaaatacccgtttctggtgaaaagtcaacgtctttatgcagaattttatcattcaccaatacctcaccactagttgcatgaatgaaaccagccatcgctcttaataacattgttttacctgacccattaattccgtatagtccgtatattgatcccccgttaaaagtatagttaacgtcagttaatacagaacgtttttttaaagttttagaaaaatgacgtaattcaattttcattttaatccctccgtaaccaatcaatttgccttagccgccaataaattaatccttcaatcaacacaaaaaaaatcagtaatattacataccacattagtaaatccacatgaagtatacttaatcgttgttgacatataaattgtggccagaccagtatctgaaaaattattgagccgccattcacaaacagactcttgccaaccattaaagaaagacctgcataaacaagtataagaaaatatcccactcgatctgaaaaatatagatttaataagaattgagttaacatatataagttacagattaaaaagctggtcagtaacattgataaaagtgaaaaagaaaccgacgaaaaaatatggaataatcccgaaaaaacaaaaaatacaactacaaacataatgtgaaacaaaatattaagtttacagatagttatattcaagtttttaaagacatagctcattttttggtaacgaataagttgtaaaactaaccaatcagaaaaccaagattgaagaagtgcaaaattcagtgtcgcaatagtaaaaaagaagaagataaacaccaaagtttgcatagtagtggcactaaaatcaacaccacgaaggatattttgaatagtgaatttaccaaataaataatttttagccagtattaaatagaaaattaacaagccaacagttaaaaatgctaatttattttgtgatttcaagtaaatcctccctcctcaatttttgaatattccaaatagctagcaaggtgataataatcacgacctgtaacaaagctgttagaatcgtaagccagccaaattgtcctttccatagccaatcaattgtattcatactggaaataggatgggtaaactcaaaggttcgacaaaactcaagggtaataacattaataaacggaacaataaagatcgttactaaagcattttttgtatattgcatgaccaaaaataataatgagccttgaattatatagtaacccagaaaaataagataacggacccctaatgctaacagtattatgggttcaaataaaaacgtatgctgcactctaatgaatagcataatcaaatccacaccttcaaaaacaatcgtgaagataattgcttggatacaaacagatttaaaaaaagcccaataatacttttgcgtatcggatcgtattaattcactcatataaatgttcaaataactttttaaaatgattgtagcaaaaataagtgaaaaaatggtagcttgtcctacgtcataatgataatttgcaacagtatcttcaattgtgtaaaaatctcgaaaatttgttattattctcggtgcatatctatttagtgataaccaataaattccaagaaaccctattaggaaaaaataaattacgccaagtcttttcttgctctcaaagaacatcagctctcacctgcctgaagtacccaataccaattactatcaaactagaagataagtaaacaattgcagccggaataatggacctcaatccgtattcaatgaagggttgcataaaataagtggagctgtacggtgacataacttgtataatccataacagaaatgcaaagggatatgcaatgtaataattggggaacataaacacaatggcctgcgtaaccataccaaaaatggcaaccgataacgtaaaaataaaaatatagatcaccacagtactgtacggatgttccatttgtaatactaataattggaaaggtttaataaccttaagttgttgcaattcatcctccatgccagaaaaatcttttcctccatgccaaataagcagcgctataagaaaattaatcactaatgaaagcagcactaaaaaagccggaatgatggccgataaagccagtttagtttgataaaatttttttctgctgttcctaatcagggtagcattaagataaccatttttcacttccgacacttggtgatccgtatataaattcaataaaattagaggcagcaaccaaataaggaccatttgcccataatggccaatagaattagaagccaaaaaactaacttctgctggatttaatataaactttgctgtgtcaaatccagcctcaatctgacttttgagctgaattaacaaatctatttctggaacaagtatgattaaggtagcaaagaaaataaatcgccaattttttaaaagtttactaatttcaaagttaaacatcagaacccctcctaccaataagaataatggtcatctacataatttgcattagatgaccaccataaaacttaattattgaattttcccagtctcttcatcccaatagcctgaaatattattattctgagccgtcagcatcacggttttcttcccatggaaagaaggattgaccctttggtacgcttcaggattccccgctatctttttgataatcgggctaacatttgcaccgcctgctttttccaaccaaaaaatcgaaatggtatgcgggccttcaccggattttgttagtttaaccttccaattatttttataattagttgtttgtctgtaccaaccagccgagtgactcttttgcttgaaaccataaacacgcatactataaccatgttcatcattaccagccaaagccgaagtagtaataaaaccaaaacttaaacatgcaacaaacaaggcagacgtaattttttcgttttcataatacatctctccttagattcctcgtatgcaactgcaattttactacgccacttcaaaaatagtctttattttctttcataggcagcactccctatttattgagaaaggttactatcacgttttaattgtaaagcgctttcattaaaaaacaacttatttttccataattttatagaaattatcgataaatataaaaacgaacccttaactcaaatttttttaaaagacgattaaaaatataatcactgcgtaattcttatatcttttttgtctaatttagttgtcgtgtgcttcctttcaaaatccagcagttaaagtttgatttgacttaaattctttaaatcattttttatttaaatcaaacgcgcaaatttttaaaatcagaaccttttaattttgtttaaccgaaattgtctgttctttcatccttggtgtactgtgcaaaccatcataatcaatctgtaattgtaagtggttaagattgagatttttcaaacctgatttctttgttaaattataggtggcttcaaattcattggttttgccattaatcaatttttgacggccttcatacaagtaatcttttccataaacactagcgttcccatcatcgtgatatgttttggccatgatagcaagcgcaccattaagctgatttcctttgtcccacataagttctctatcagacgataatccggatcctgttaaataataacgcaaagtcaatttaccatttcttaacgttggctttttaaatctgaaaacttccgtcgttcgttttgctttgatcgtcgttggtaacgaacttaatgccgttcgtgcggaaacctcccatgtggataatgttggttctacagttatttttgtaattcgttttggcaactcttttactcgataacctactatgcgttgttttcctttcttgctcagaaccatgggatcttgattggcgagcatataatctttgtgacttccattaacgaaaattttaaataactgaaagtcatctttagaaactcgttgtgtttcctgtacctttaacaaaccagttcctccagaatactcatcaattccaagtaatttcaatttgacgtccccgtttgccaaagtaatgtttccagtaagcttttgtgtgcttaccttacttggtgctaaccgtaaattaaatgcccaacgcccagcatgacccttgaacctggtgaaaacaattggaaacttaatcgtactttttgaaattttgcctttaatggtcccgtctagccaaaaacgataatgtcctgttgatatcttccgaagatccgcgctactttgagaaaatttcaccccaccgcggccaatgtaaaagtcaaaccaatcatcccatgcaccgttaactccactgatggttccagtaattgcaactgtctttccctgtacatatacagtttttagtgtcatcttcataccgttggaagttcgtgtctgattcaaattctgcgtttttccattagtttcaacaatcgttcccagatcatcatcaaatttcgcaaagaaattcccaataattggtgtttgtgccatcacatgattaaccggtgttacgtacattccgctaagcgttagcaggcaaattgcgactgcaagggtcacaaatccccataatacatggtgatggcgccgttttagtctaacacctgattttaataacgcttgcgtaatcgttgtcttggtttcttttgggttcacagtttgtgcctgactaagttgctcaaccaattgcgaaaatttttcatttttcaaaatagtcccctcctaaccacgtcttcagttgagatttaccacgcttcaaatgcgatttaacagtgttttctggcatcccaacaagatcgctaatttcgtgaatggataatccattataataaaacattaataatacttaccgatagccgtcatttaaacgttttaatccccccaagagatctaatttttcatcaaccgaaacgtttgctaaattcgttggcatttcgggaaggtctgccaaatcacaaacttcatgggcttgttctgaatatctgcggtaacactgacgaatcaagattcgcgttaaccaagttcgaaatagcgcgggtttccgcagttgactgattgaatgcaatgcgatcagtgtcgtctcgctaatagcatcttgaacatcaacatcgcgtgacagataaagatgtccagttcgcgttaaataatcggcctggcctaaaacaagttgggaaaatgcttgctgatccccccgaatagcccgtttgactgttctgatttttactttattcacgtgacttaccccctttcacttattagtggttagttcgggccaaaaagttgcaacaaaatttgactaactaaataaaaagctactagtaacattttatcgttagctagcaactttttgtcatcaaatatttaactgttcagtatccttttatgcaaacatcggctccaaaagcgtgatggctttccggtcaaaatcaacttgtgtctcaccaccataggggagcgccgtccttggataggcatggccaaaattgacatttgctaaaataggtaactgatatgaatcggtaatttccagtaaaatctgcttatattcgtcataaaaggcttctgcctgtggtttgccgacaaggattgctgaaatagctgaaaaaatgccctcagcatctaatgcaagtaacattttgcgatagagttctggattgggtttttcctcactagtttcaataaacataattttgtcttgccactcgtttaagctaggaaataagtgatacttttctgtaacttctttttcatcaggatagcgagttcctgacaaaatatcatacaaactatcgagacaaccacccaatagtcggcccgtaatttggcctgatcctctcaacacctcataccctttttgttccatatgctgtttccgatgcattccgacagctgcagatgaaaaatcctcgcgttcctcataccaaatagcactggatgtaattgaggttgtcgcctcatttctaaaataattcataaaggtgtgtttggtgtatgggagcatttcttgatccaactctgccaaatcattcagaaaatttggaccgtaaaagatctgcattcctaattgatagaacatcaaatgattaattgttgtatctgaaaagccagtaaacaacttaggatgggaatggacattatgaacaaatgtttcatcctctaagagataaggtaatagccgataagtatcgtcgccaccaattgcacaaacgatgcccttaatttctggatcggcaaaagcagtttttaaatcatcagcgcgcgcctgcggatgatcagctaaatactggattcctttcagtgcgttgggcataaaaactggctgcaattgcatttcttttaaccgtttaattcctaattgcaattgatgggtggcaaagctttcgccaagcgttccactagacaaactgacaatcgcaattttactattcggggttaagacttgaggcttttttaacatgggcgttcattcctcgcattatatattttgtgtatttaacaaatactatactgccaattggtgtggtaaccaacataacaactttcataatccgcgatacaatgccatgttatcattttagttttggcatagccacactaaatggtgtaccatagagatgtatttgtaaaagacaaaatacacttatgggggaatttacaatgaacgaaaaatatcagcaactttccgaactaattggtaaagcattttttgaaccagaatttaaatctgatccaaaaattcaaaatactatcacaaccgccgcaactcaacttcataatcatgaagattacacaaaaattgcagttgaactttcgctgggcattacaaatctctatttaacacagcacaaagtcgcgacaattcttaaaactatctatgattttgtcgcagacgatgctgatgcaactaaattagatcttcaaacaagacggaatttgggtattctttctggttatgtacgatctcctttgaatagtgacaagatatggtaacttcttaaaaattagttagacctgcatttcaaaaaaaagtacacagagctataaaaaagggcttcaaaccactgatattgcaatggtttgaagcccttttccagttttataatagcccgcacggggttcgaacccgtagctccgccttgagagggcgacgtcttaaaccaatttgaccagcgggcaaaaatagtactgttctaatttatcttatttgagccacaaagtcaataccttagcttcctttcatttttaaaatggtcaaataaacaaaagtaacaaaaagatagatccagtatataaatatcgcgatcagaatatacgggataaaagcaaagttcagcagattttcactgaccacacacaaaattgcaatgactgcccagataactaacttttcttttgtatctgccaaagtaaccttaagctcacggttactcataggtcagctcaagcatatatgctttctttccaacaacgtgtgcagtcgttacccaaacctcatgatagcttttcattggcttcttcgttaaaccattaaagtagtccatcaaaacgttatatttatcaacaaactcatccgaaagtcggtcaactagcaaagtttcgtcaggaaagtatatttctggattagcaactgggatgctatcactgatttttaattgcacaacatttgtatatcctaaggtattcacttcagcacgttctggatactcacgaatttgtgataaaacattataaatcgaatcagaatttgtagccatattttcacctcataacagtcttattgtagcaaaaagctgagtgcttgtcagtttataaagaatggttgtaaacatatgttgacagttttacagaaaaacggtaaacttatataggtaaatttagtgggcattcgccaaatggtaaggccacggactctgaatccgtaatttactggttcgatcccagtatgcccaatattaatagacctcaaagcgttgtttttcaatgccttgaggcctttttttatccgaagaaatttacggtttcatcaccatttaagtagtggacaaaacgcaataaaacttgtcggtcctgtaatctgttaaatactttaaccttattcttgccgtcctctcgataggtaaagacaatcgcattaccactcttaatctttaatttggtgattaacgcttgataacgttttgaaccaagcttgcgccgtaaagattttaaattcgcacaatataaatctgtctgactacttaaagagtatcttcgaacttcttttctagtttgcttataatatttgctatccggattataaaagtaaaacccatcttcataggaactatatttttttgcatatacctttttcataacctgattaactgaaagtggaattggtgtcacatgctgcttcgtataatctggctgattcaagaattgaaacacaaccccggcacccacaattagcagcgccactgctaatccccaatttttttgaggctgtgaacggtcagaatagacgaagaaaattaccataaaaataaccatcaatccaaccagaatccacaaagaaagaatgtaaaaacgcagctgcgaggtatacgtcgtaacccatctatgtgtgagttgataataattattaattcgcatatacagtaaaattaataaaacagcgccggtcaggccttctacaaaattgatctttgtttgtgttcgcacattctcacaccctattcgttttttcatatgtacaaaaagccacccgaacaaactcgtagtagctttatgaattaatatttaaatttataaattatgtggttggtcatctttagttcctaatagtttaccaataactggaattttaccaaattcatcagaactatccgaaggcaccacaaccatattggtatttgatttcgccaaatcagaaaaggcattgattgactggttttggaaatacttgtctgtcgcctctgccaatccagcctgaactgtatcaattcgataacgctccgcattagctcgcgtttttgttgcatccgcttcggctttagcagttgccatcaacgcatcattcttagccttggtagttaactcaattgatttggcttctccttcggcctttgcaattgtggcaacccgttcacgatcagccgtcaattgtttgtccatcgcttcttggattgcacgtgaaggtgtcaattcgtcaatattaattcgatccacattaattccgtacgtattggtcaaatcgccaattgccaatgtcaactcctggttgattttagcagttgaccctaatgcttcattcaaatccattcggccaataatatctcgtaaatgtccccgaactaattgcgccattgattcaacagaatccgtattttcatactgatatttcaccggatctgtgatatggaaatttagcgtcaagcttgctgaaacgtctgcattatcttttgtgataatagaatagttaggcagtgcgaggggttccattgccaaactcacatttctgatcttttggaaaaatggaaagtaaaaatggaatcctggatcaacactgcgtttgtatttccctaatgtttcaactaatcctcgattattttgtggtacaattctaagtccaaatggcatagtaaagctcctccgattttttggtattcgtgcatgaactgttctctcaggcttattttgcgtatgacgttcatcttccttagcgagtttttgtgtcgaacgttgtctacgttttatagcagcctgttgtaccttattgtattgcgctgagtaatcaccgttcatcgcagcggtcataatttctcccagtgcaccaaacggctttttttgttgatttgccattccttatctcccccaaatggctaaattttttgtaacgttaagatatttccatttgcctcaatcacagcatatttagccttatcatcaacatcagaattatcgttaattaaataacgataataaattcccgttaccagaaccagaccgttttccatattgacatccgaaccagaaacagtcttgccaattatctggcaattttcaaaactttttgtaccgtgattttctgacaacaaacttacaatatacatattcacactttgattagctcgattggcttcttctgctaaccgatcataaagagactgatccaaacgtaataaaaaccgcttatctttttggtcattcgccaatcccggtcacctcacttaatatcagcttgatatcaccataatagtaaagatttttcttccgaaagtcaattaaaaattaccaaaaatagttttagtttgaaatcataaaaaagctctgcaaaatgacaagtcatgaaactcatatcaattctgcagaacttattttgttaaactactagaaagtcttatttaccaaggcgttcgttgagttcttttgtttgtgcttcatagccgggacggccaagtaaagcaaacatattatttttataggcttcaacaccgggttggttgaatggattaattccattcaagtacccagaaataccaacagctgcttcaaagaagtagatcaagtagcccaatgtgtaagcatcctgttgaggaatattaacattcataacaggaacgccaccatcattatgagctaaggtaacaccttgatgagccttcttattaacttcatccattgttcgaccttcaagatacttaagcccgtcaagattcttatcttccttaggaatgtttaaatcatggttaggcttgtcaacattcacaacggtttccataaggttacgacggccttcttgaatatactgaccaagtgaatgtaaatcagttgagaagttagctgatgaaggatagatacccttttggtcttttccttctgactcacccatcaattgtttccaccactcgccaaagtattgcaatgttggttcgaagttttctaacaattcagttgtgtaacccttacgatacaagatgttacgtaatgcagcatacttgtaagcgtcattctttgtaacgtcgggatctttatatgtgtcgcgagcgtcagcagcacccttcattaattgatcaatgtcaccaccagcaacagcaattggtaataaaccgacagcagaaagaactgagaaccgtccaccaatatcatcaggtacaacgtactcttcataaccttctgcatcagattccgtcttcaaagcacccttagctttatcagttgtcgcaaagattcgttccttagcaccatctttaccgtatttagcaattaacttgtccttcagtacacggaaagcaattgaaggttcagtagttgtacctgattttgaaataacattgatcgaaaagtcacgatcgccaatcaagtttactaaatctgttaagtaagttgaactaattgagtttccagcaaagaatacttggggaatgccgttacgttgttccttagggagcaagttgtagaaagtatttccaagaaaatcaattgctgcacgtgcacctaaatatgagccaccaataccgatagcaacaaaaacctcagaattattctgaattttttttgctgctgccttgatacgtgcaaattcatttttatcataatcaactggtaaatcaatgaatccacggaaatcatttccagcaccagtaccttcacgtaattctttatctgctgcagtaactaggggttgcatttcagcaagttcattataatgaacaaactttgaaacagctgaaccgtcaaacgaaatatgtgccattgtttacttacctcactttgtatttttaatgttccatcaatttattatacacccgattactaaaatttgaagcgtgaccaaaattgttcaactcaaaattgctactttctaaaaaatgtataaaaaaagcagtatttctactgtttttaccattaatcaatttacttcataattgccaacaaggttgaccccacaataatcaaaactgatccaaaaataacatactgcatttcacgatgcgttttgtgttcacctaagaaccagatgctaccgaatgttgaaataacgattccggcttgagcaagtgaataactaattgccaaaccgacgcttggaattgctaagaacatgaaaatgttcccaattccccaaactaaaccagtgatgacatttttccaagtatgactatctttgaatgccgtaacggctgcttttgaaacaaatacaaaaacaacggctccggcaaacattccgatcgcttgtggcaaaataactgctttggcattcacatcagcaaagcgtacaaccacagtatagccaatgtaaccaattgtggaaatcaccaatgcccgaataccagcagccatatcttcatccttattatgttctggatcgcttttatctcgtaaagaagtaaacgtggcacctgcaatcaatgcgatcacagcaacggttcccatggtaatcatttttccagtagtccactcgtgccaaattaacactcctgctaaagcattaccggccaattgcaacccagttgaaagaggcacagttttagaaaccccaatttttttcattgaggtaaactgcatcccttgtccaactgcccagaataaaccggaaataattcctgcaatccaaactttagctgataatgttggttggtataaaaaccaagtaaataccgcaaaaaccacagcacccattgtcattcctaaagtttgttgaggtgccgatccgccaagacgacctgacactagtccaatactaccccaagctattgctgggatcagtgcaattatgatacccattataaattctccttattctctttaaattaaagcctataccaagacaaagaaacattttaacaggaaagtaatcgtttttacaagtgataaattattaaatttaattgatataccagtttaaatatatataaacagctgatacgaccaggtttcaacgcacttattttttgttcattaaaatattggcataggccaaaaatgctcccaatttagccaattttgtctattcgtttatcttttattcgtaattatcaccgttatttcatttctgtttctcccataaataacgcttgaaaattggtctgcattttaataatcaaatgtgttaaaataaatgtgtacgtttaatgcaacctttttacacatcgttgtaatatattttgggaggattttatttatgtcattagttaatggtaacgaaatctttgctgaagctcgcaaaggtcactacgctgttggtgcttttaacactaacaacttggaatggacacgtgcaattcttggcgctgctcaagaaaaaggcactccagttttgatccaaacttctatgggagctgcaaagtacatgggtggttacgaactttgtttaaacttagttcaacaaaccattaaatcaatgaacatcacagttccagttatcatgcatttagaccatggtaactacgaagctgctaaagaatgtatcgaagttggttacaactcagttatgtttgatggccatgatttaccatttgcagaaaacttagaaaaaactaaggaaatcgttaagttggcacatgctaaaggtatgtccgttgaagctgaagttggttcaatcggtggagaagaagacggtatcattggtgaaggtgaattagctgatgttgaagaagctaaacaaatcgccgcaactggtgttgactaccttgcttgtggaattggtaatattcatggccaatatccagaaaactggaagggcttgaaattcgaacgtctccaagaattagctgacgtaatttctactccacttgttttacatggtggttcaggaattcctaaggaacaaatccaaaaagctatttcaatgggtgttgcaaaggttaacgttaacactgaatgccagatggctttcgcagctgcaactcgtaagtatattgaagaaggacatgaccaaaatgatattaaaggttatgaccctcgtaagttacttgcacctggtacaaaagctattaaagacacagttgagagccgtatcgaatggttcggtactccagctgctaaataatctagctaatataaaagcaggaattcaattgaattcctgctttttttattgcttgtcacagaaagttaagcctcttagctttctgtttttttatcttcacaaggtaattgaagcgtaaatgtggtccctttgcctaattcactagaaacattgattgtccctttatgagccttaacaagttgatgcacaattgccatgcccaaaccagattccccatacttggtgtttttcctagaggcatcagccttgtaatatcgttcccaaatgttcttcatttgatcatccgacatgccaatgcccgtatcactaatcgaaatgacacaatttttatctttatcattatgagccgtaatcgttattataccgccattcgtaaactgaatcgagttttgcatgatgttgaacattatttgcacaaatctatcatagtccgcataaaccgtgacattgtcagcaacctgggtgacaaactgatcttttgcctcatgggcctttttttgtaactgttcaactaaattattcacaacctcatggacccgaatctcatgacggtttaaaatgatttgatttgtccgaattttttcgtaatccaaattatcgttgaccaatcgaattaagcgcttggtttcattgctcatcaattgtagactctcttcacgactttcttctggaatggcatcataggttaacccttccaaaagaccattaattgtcgtcagaggggttcgcatttcatgcgcagcgtccgcaagaaattctcgccgtcgctgttcctgacgcttgatttcttcgttcgacgccttaagtgatttcgtcatatgattaaagtctgatgctaaaccatcgatttcatcattaccttttgttggcaccgtaatatcaaaattaccttcgccaattttgtgagccgcctttcggatacggtctatccgcgaaaccgaatatttggccagcccgtaggcaataaaaattgctgccagtccagaaataagaaaagctattaataaattatgttggatttttcgcatattggactgaatattagcaaccggcgaacccactaaaacgaccgcaatcaattcaccgttttcatttctgtacggtttgatgatgtccgtcatcgattgcgttttgctttttccagtacgattaaagcgccgggcagattttgttgtcagtgtttcaccacttttcagctttttccactggcttttattgataactggggaaaaaccatttttcggataagcaatcgtatttttcttgatataaattgaaaaatgaattgcttggtttgccagcaaccgttcactattttgtaagccgcccagttggattccttcaaattcgccactagaattcaccacaactgattgttgaaaaacactatcggcataactttcaagctgcttccaagtatcttgataaaccattcgattggaaaactgaataaatgccaacccaaatataattacggttgtaaaaattaccgcaaaaaaagctaacatctgttgatatagcagtttcaaacgcatgtttaatcccccgctttgctatcatcgaacttatatccgactccccaaactgtttggatcacctgtggtcctactttttcaattttctgccgtaactttttaatatgcgcatcaacagttctttcatccccataaaactcataattccaaactaattggagtaattgttcccgggaaaaaacttgttttggcttttgcgctaaggttttcaacaaatcaaattctttgggtgttaaatcaggaattaatttatcatctaaataagcctctctagttgaagaacttaacttaaagctttctgtctcaacatcgtaattggtttgttgattgtccgtttcttctgtgctgctcgttgtgcccatttgtgcacgccgatgcaaagctttgattctggcaattaaggtaattggactgaacggcttagtgacataatcgtcagcgcccatctcaaggccaagaacttgatcactttccgaatcccttgccgtcagcataatgatcggcacagtttttgaaatttgtcgaatctccgaactaacttccatgccgtcttttccaggtaagtttaaatcaagtgtaatcatgtcccaatcatttggtgcactcttaaacatctcaaccgcttcgttaccatcatatgcaaaagatgcatcccactgttcttttttaaaaaacatgcccatcatttcggacaccgatttgttgtcttcaatcattaaaattttcatacgtacccctctttacaaatttctccatgatcctagtataattcaaacgttcatttaaacatagaagtgttttgcctaattttcaaactagcataccatttttagattaatcgtaaataaaagtttttcaataagcacgaaaattataaactccctcaagacatgttaaactttgcgtatagttgacagtcaaggttatttgagaggagatatttaatgttactcagagttcaaaccaccgatgatgaagttctgtatgtaaatgagaatcaaatcgcttatgtcaaaaaagtagatactcgtttactagatgaagaaagtacttggcaagttttcctgacagatgttgctgaaaccagctttattattccgtatagcgagttaaaacgacaaaaacaagtcgtttagtacaactcgctcacattattttcaaacttatatagcgaagttgtccccaaaaattagctaaggaagtggccaatatggatgatgaacatattaaagaaacttttaaacaggataagaagcgcaatggcgcccctgacagtaatatgagttatgatgaacaaaacgataatcctatggaacctggtgaaaaatcaccaaagcaaacgccggattctatccctaatcccaatgaaaacaacgacttagaagaaaaccatttggatcacttactttatgatgagtcacaagatagtgttcatgaagatggagactatcttagtgaaaaattagaccacaaataagtttaaatacagagcctgccgcaaaatgatacacggtaggctctttcagttactcatgattaatcactcgtttcttatatctagagtacctcaatccgatttcgtgtactataatatccagtaagaaaggtcgtggtagaatatgctggtattactaacaatgctgatgtttttcttcatgttaaaactattatatggcctcacaaaatttctggccccgttgatactgttagccaccgtcatgtcactatttttaactttttggtgggtgattttgtggattgccgtggtaggaattgttgggttaggaatttacttaaatgtcactgacaaacaaataaaggacggtcactagtttggcgatctctttctgagttaaaacacacaaatgtcaaaccaaatatatttcaaacttatgacgagttgccaaaaaagccagaatattggcaagacatctcctaataaactggcttttttaaaacattccaagttgtaaatgtttgatctgcagagtcaaacctgtcattatttttcaaaaacgcttttgcctttaaaactaaaggagaagtgtttttttcgtttaaatctgccaatgacaccaattttgcacccagcgaatcttgtccaataaattgagcaacatgatcgaccgcaacgccctgccactgctgaatatcataaaatacacagatgtgttggttatattcccatttcttgtagtgccaaggatatttaaagctcgttatccccaattgcctaattttcaacggttgaaggccagtttcctccgcaatttcgcggacaattgccttatccaaagattcaccgtcctctaaactgccgccaggtaaatcaaaccgatttatgtatggtcccccatttttcttaataacaactaactttccgtcgataaaaataattccgtataccccaaacgctcgatggtacttcttagtcatttttgacacccactttcaacgccttagaaaacaagtttactacgaaagcttttttgtaatactttcataaattagactacttaattcatcttttttacctgaataccgaattttatatgccgacttatttagtaatccatccagtaatttactaatttcgctactctgcacttctttgtgccgtttttcaattaatgttgaccatggtatattatggccaacattgattccgcggaaactattttgtaagttcttttttagttgtattttttcaattttattacattcaggcactaaaccttcacctatttttgggaacaatatggtacttaattccgtccactctgagattaattttacgttaaacttgttagcaaaactttgccaatttaattctggttttaaatgcgtactccacagatcatgatcgctcaactctctcatgttttcaggtataatatcctgtaactgttcaaatttggaagcagtacctaacccaatatttatgctttctggagtacccttaacccatatttttccatcaacttgcttaacaaaagtaagatcattactaagcaaatcgtaaccaagatcaagaagatttactaaggtagtcgttttgccagctcccttatctccacaaattaaaatagctttcccagtattatctaccgcacaggatgaatgtaacattatggatggtgtagcttgggattgtaccagtccataaatcagttcatcacggatcactcttttacaggcttgattgtaatgtaaccgatttgaaaaaataattgtttcatctcgattagtataaataatacaatgattttgagaatcataaacaaagtcttcatccgtagaaatgatatattttgctttttgaaatacttgattttcgcttggagaatagtgttttatcttttttgcatgaacaaaatatttttcatagtcgtccacactttccaaaacaaaacaataaactttatttttttctcccatacttgaaccgtttgaaacaaaatatggagataaatgtttatacaaataattcccaaaatccttaccttcgtaaaaaaccgacaaatattcaacttcaagatgttctaaatctttttgctttttatatttttttgaaatttttatcaaatcatttaaagctttttccataaaaaccaccttcctaaactttttctataaattcatatggtttccaatttgggatcttatcgttaccagacagctctataactagactacccaatatgttatttagtgattgaagaatcgccttctgcaatctttctttagcctgagacaatgattgaataaaattttccttactcttgtctcacaggcaaaatctagagtttgtgattttgaattcctgtttgacatgatcccaaatagaagatctcttttcaaaaactaattagctgatacatagtgttttaaccctaaattccactctacgtatgaaaataacgacaacactattaatataagtatgttttccaacatccaactagctttcactccccctttcattaaaagaactggcaaatttgtagcagataatgaagggattatccacatgaagaagatttgaaaaatttttggataaatctgataaggtctgttcgatgcatccattaagtattctgggaccccatttaatgcggataaattatttatccaaaaactcaaagttacaataattggttctataatatttggtactgatagaaaaatcttctctcagtaccaattttgttttatgataaaaaaatagagatgaagacacacttcatctcaaagaaacaatccctacactgaaaggaatgtcctacatgaagaattgtacactggatctattgggaattaaagactcacacctggaatttgatccaaaatataagaataaagtgatagctgcaggattttaccaacataaaaaagtccgcaagatccatttgcggcaatcttatccttgtgcttgcccagtttgtggtcaaaaaatgcgctacaacggttttaaaaccgttgagatgctcggtttgccttcgggtgggatcacaaatgttttttcgatccgcaaacaaaaatatctctgcccggcttcagctgcctgccctaaaactattacaaaacttgcggagatcaaggacgtcaaggctaacgaccaaatctcacaagccgttaaatatcaggctatttctaaattagaccagaatatctcacaaaaagatattgccgctgattttgggatctctggaatgacagtgatgcgctttgcgcaagagctctcaacttacttaaggcccaatcatcatttcttaccgcaaaatatcgcttttgacgactttaaagcgggcaacttttctagtagcggcatgagtatcattgtcatggacattgcgacacgccgcacgttagatatcgtgcgttctcggcataatacatacttacgaagttactttttacaatatgaccgtcaagctcgctgggcagtccaaacggtcacagttgatctgtactcgccttatcgatccttgatccatgagatctttccgcaagcgctgatcattgccgaccgcttccatgtcgtaacccaagcttatcgggccttaaacttagttcggacacaaaccatgaaacagtcgggacagggttcgcacaacgcacgtgctttgaaacattattggaaattgttaactaaagactcgaccaaacttgattttaaaacctatcgtaaaagcagaaactttcgtaatatgcagttatgtgaacaggatattgtggagcgtttattaaacatgtcctccgctttgcgacaagcttacgtttattatcaaacacttttacaagctgtccagcagcgagatccaaggctcttagaaagtctaacacgttcagctgcaggcatgcctgagcccatcaaaaaaactaatcgtaccttgcgtaaacatctacaagaaatcaagaacagctttcagacgaccttttctaatggacccgtggaaggaacaaacaacaagatcaaagccattaaaaagactgcttacggtttccggaactttgaaaacttccgtttacgtcttctcatcgaattaaagaatagttatgtcagtttgaattttcatagtcgcattaaaaaagctgctcattccattcaggaacaagcagcttgaccaagtagaccaattgcttattatttttaataattcatttcatcagtaccacttgataaagaacctattaataaagaagaaagtttaatggctgatttatctgtgtttttattatcagcagcaattaagttatagatgttttctatgtgcttaatatagcgagaaatatcaaatttcaaaactgtttttttgatatctgtatgattatatttaccacgcaaacgatagatttgccggcatgcagctataaaagctttttggtcgttcattggagttaaaattccattgtgggaattaatgatgtctgccggtccagtaggacagtttgttgaaacaattggcaagccataagaagcagcttcaataacaaccattgggaatccctcatattttgaacagagcagcaggcaatcagcttcattaattgcttcccaaggattaggcatccaaccttgccagttaatgttttgtgaaatatgcaaatcatttgctaatgtttttgcttttggaagatcagctcccttgccaaagatgtccagtttccaaggaatattaagctgtgccattgattcaagaagcatacgtacatttttttgatcatccaacaatattcttccaataaaaattgcatggaaaggagcgttagctttaggtgtgttgattgttttcttatttacagtgcggataggattatagatcagaaagattttttgggctgggaccccgagtttgatcaactgtttttttatccctgtactaattgcaagatgatattctgagaaagcaagttcttgacgatcaaaaatgtttgattcagcaatggaggtatgtccccaagaaacaattttataatgaaggtcatattttttcctgatctgataggcagttacacaagctctgccttcgagtcccaaaacgatatctggttctgctgctaaaacatttttttcaataaactctttttgtgcttgtgtatcttgtgcatggcaaattttaagttggtagccggtagtacgtgtaatccattggagccattcaggttttccgcttttagggatcaaaacctgatattcattttttaaatcttcgttgaccaagttcgaaatgactctttcggtaccgccatgtccctctaaatactgtgttattaatgttattttcacgataattcatcctttcattttatgaagtcaacattaatctgatgtaatcttaaataagttgtattagtgagtcagtaattgttaattaacttaaaaattctaaaaatagttacaccgcatttgttaattataaaaaatttaaaacacaataatgcagttgtaacaaaagtacagacagctaaggtatgtgattttgtttcaaacaaatgcagaactcgattttaaaattcacccggctttcattttatcaacaaagaaaatagtttacttatggctagttggatacataagaatggcattatttaaataataaaaaaataaaggtacaataaccttatccaaatggttgttgaactgatatgacaatacagaaactaaagaatctatattatacttacccccatctaaactttattatagatctaatcaacagaaaaactcaaatagttgaattttgtaaacaaaataatgatatggagagttgtccgagctggccgaaggagcatgactggaaatcatgtagacggatttatccgtctcaagggttcgaatcccttactctccgttgtaattaagtatgacccgttggtcaagtggtttaagacactgccctttcacggcagtaacatgggttcgaatcccgtacgggtcatttatggagggttagctcagttgggagagcgtctgccttacaagcagagggtcacaggttcgagccctgtaccctccattgaaattatggttccatggtctagttggtttaggacgcctgcctgtcacgcaggagatcacgagttcgagtctcgttggaaccgttaatggcgcagtagctcagtcggtagagcaacggattgaagctccgtgtgtcggcagttcgattctgtcctgcgccatatatggaagggtagcgaagtctggctaaacgcggcggactgtaaatccgctccttcgggttcggtggttcgaatccactcccttccattttaatgatagggatatagtttaatggtagaactacggtctccaaaaccgtcgatgtgggttcaactcctactatccctgccattgatggcggtagtggcgaagtggttaacgcaccggattgtggctccggcacgcgtgggttcgattcccacctaccgccctaaggatttcatttgttatccttgaggttttgtataattaacataaccagattagatgccgctgtggcggaattggcagacgcgctggactcaaaatccagttccctttaccgggagtgtgggttcgacccccaccggcggcattataatgcaaattcttaatttgcaatttgtagtgaacaaggcgcgatatatcagcattatttgatgccttaggcagaatgttgggtattgcgtttttagtttggtacgagtttatatggcggtatagccaagtggtaaggcagaggtctgcaaaaccttcatcaccggttcaaatccggttaccgccttcaaattagtgagcatgaataaaagaggaattcagcctttaaagttgaattcctctttttgaattgtaattttttattttttatttaactttataattttacgaatactcatgataatatcggtaaaatcataggctgcaaaaattgtaataatccatcgataaccattcgatgaatctgttgttagcaaaaaatacataaagaatatgccaaataggagatccaaaatcatattaatcagcattgctcgtgtaaccttaattttcataaaaagacctttctcaattcatacgttaactcaatcatatcacaaaataattttttaatgcagcttctccttgacaatttacgtttacaaatgtaatctaataaatgaagattacgtttgtaaacgggaggaattgaaatgacagaggaattgccgattaccacttctgagtgggaagttatgcgtatcatctggacactaggtgaagctactagtacggaagtaattcaattattagtaaagaagcgtgattggaaggaatcaacagttaaaactttgattggtcgcttaatgcaaaaacaaatgttaactgccaaaaaagaggggcattcaaacatttatcaatgcacaatttctgagcgggttgcaatgcaaagagaagccacgcgcctgtttcaaaatatgtgtgcaatgaaaaacggcgaagtgttggcacaacttgttagtgagattcagttaagtaagacggatatagaaaaattgcaagcagtgttagcggataaaattaaagatgcaccagacgaggttgcatgtaactgtctgccaaaggaggaaactagagaatgaatcattcaaaaatgaaaatggaaatgaacaatggtgaaatggacatggatatggatcaagatatgatgaatcatggtggtcatatgatgcatatgggaaacttaaagcaaaaattctggatatctttaattttgacaattcccattattctaatgagtccaatgatggggatgaacttgccatttcaatttacgtttaacggatctgattggattgttgcaattttagctacggtactgtttttctatggtgggaaaccattttttagcggcgcaaaaggagaattacaagcccgtcaacctgccatgatgatgttgattgcgatggggatttcagtttcttatatttatagcatctatgcgtttgttgctaacgacattcttaaaattcaaccccaaaaagaaagctttttctgggaactatcaacgctgattgtgattatgttacttggacactggattgaaatgaatgcagtcatgcatgctggaagtgccgttgatgcattaggaaagctcttaccagatgaggcacatcttgtattagatggcagagttcaagaaattaagagctctgaaataaaggaaacccaaatcatacaagtacgcgccggtgaaaaaattccggccgatggagtcttagtttcgggtgaatctagtgtaaacgaagctatggttactggtgaagctcagcaagtcacaaaaaaagttggtaacaatgtgattggtggttcaattaatggggatggcacgtttgaatttagagtgactggaacagggaaaacgggttatttagcgcaggtccaaaagctagtttcaaatgcccaagaaaacaaatcaaaggttgaaaatatggctgatcgggtggctggatggttattctatgctgccttggctattggtattattgcatttataacatggacaacaattagtggtctttcaatgggactttccattgcagtaacagtgttgattattgcttgcccacatgctttaggtcttgctattccactcgtaactgcacgtagtaccgcattggcggccaatcatggtcttctaattcgtaatcgtgatgcgatggagtctattaaaaaaattaactatgttttaatggataaaacaggaactttgacggaaggacaattcaaagttcatcatgtggaaagttaccaatcaaatttaagtaatgatgaagttttacggctaatggcggcattggaagcagattcgagtcatccaatggctattggaattttaaacgaggctaaacataaaaaaatttcgttaccaagtgtcaaaaaaacaagtcaaattacaggtgctgggttaaagggaacaattgatggaaaagaatataaactggtttcagcaacttatttaactgagcaaaacattgactttgacgaacaagggtttgaaaaatgggctaaggaaggcaattcggttgcttacctcactcaaaatcgagaaataatcgggatgattgctgaaggagatcagattaaggcgactgccaaacgcgcaattcaggcgtttaaggacatgcaaattcaaccggttatgttgactggtgataacgaacaagtggcttcagtggtggctcacgagcttggtatttcaaactatcgtgctcaactacatcctgaagataagcaaaaaatcattactgaataccagaaaaagggaaattacgttatgatggttggcgatggggtcaacgatgcaccaagtttggccaaggctgatattggtattgcaattggctctggaacggatgttgcaattgattcagccgatattattctagtcaaaagtgatccaatggatattgtcagtttcattaaactagccaagaatacacacagtaaaatgatgcaaaatctttggtggggggctggatataacctgatcgctattccattagcagcaggggtcttagcttcactaggatttatgttggatccaatggttggggctgcaatcatgtccatgagtacaattatcgtggcaattaatgcaatgactttaaaagttcaaaattaaaaactgcgtaaattaagggatgaaagtcctgaagtttacgcagtttttattaagattccaaactatgaagttgataggcagtgtaattagagtcgtgataattatatgcaccactatcactgtatattttgaacggttcataactttcagaacgccgccaaattgagtagtcagagtccaattgccaaatagttaaaagtactcgctcattcggccttttttgaggttgcaggacaaataaatcgtttaggcccagtggtaaacgttcaggtgttgcaagttgtgaaattttggcatccaagaccttaatttcttctttagaaagcgtcataaaagaaaaacgatagaatccattccaactgaaattaccggtgtgaaatttcacctgataaattaacgggttggcaaaaacagaaggatcgcctgaaacatctagtaactgtaagtcattgtggattgaagtgctggaaagtgtaataaattgtcggtccggattgtttttttcaatttgttttaaaactggccaactgccaaatgttgatgaaattttatcgaccatagtaatccctccaatatgtttacgtctttattataccttgttccacccaaattatgaaaaggttttctctttcaaacagaatatgttagattagagaggagggtatcccggaatggaatgctaagcttaagcgaaggagactatgaaaatgaaattaacagtattaggttattatggtggttttccatggaatggtgacggaactagtgcttacttagtgcaatcaaacggttttaatttacttttagactgtgggagtggggctttattaactttggaaaaagtgttagatcccttgcagttagacgcggttttgctctcgcattatcatcatgatcataccgcagatgttggtgttttacagtacttttggcaattaaaaacgggatccaaaaaggttcccattttgccaatttatggacatacgcaagatcccttaaattttggtgcattgacttggccaggggcaacaattggaaaaagttacagtgcagatcaagctttgaatataggtccctttaagatcacatttttacaaacccatcatccggtggcggcgtttgcagtacggatagaagaagttgcaactcacaaagtacttgtctttacttctgacaccgcctattatccagagttagcagactttgcagaaaaagccgatttattaatgactgatacaaacttttatgcggataaagaaggtaagaagtggcatatgacttcaactgaatctggtgaagttgctaagaatgcaaatgtgaaaaatcttttgttaacccatttaccacaatcgggtaatttggataatttggtgacagaggccaaaagaaaagcgggaacagatgttcaagtgatgcgtgcttcaaaactctttgaatacacggtttagcaccacgaatttaaaattggtataggtgataaaaaggcagaaaattatcatgattttaacattttatcattattaaatattattgaaatcaattagaaaataattaagaagagttcgtgaacaaattaactatatgcgtgtttttgctatattactctgactagttgaacaaaaataatcattatgtcaattaacagtttacaaaaagtaagaacttttttgaaaaaactatagctttaattttagaatcaggttataatagtcattgtaaagaaattgaacttgcttaatatttagcacaatttggttcgattgctaaggaggaaaaaatatggttactttatatacttcaccaagttgcacatcttgcagaaaagcgcgggcttggttaaaagaaaacaacattccttttaaggaacgtaatattttttccgaaccattgacaatggatgagattaaatcaatcctgagaatgactgaaaatggaacggaagaaatcatttcaaaacgttctaaagtatttcaaaaacttaatattaatcttgatgaattaccattacaaaaactatttgatttaattcaaaaaaatccaggtctgcttcgtcgaccaattattttggatgaaaagcggcttcaggtaggctataacgaagatgaaattcgtcgtttcttacctcgtgatgttcgggcttatgaacttcgtgaagcacaacgtttagcggatttgtaaaataaaagacaggttaattgcaaaaagttagatttgtgggataatatccatgaatctaattttttattgggttctgttgtgacgcacaacagataaatgtaacgagaggttgggggtgcgaacgatggaaatggaacgaataaatgatgatacgattcgagtcttaatcggtaacgatgatttgactgaacgtggaattacggtccttgatttattaggaagtcacaaacaaatagaagattttttctatagtattttacaagaggtagatacggatcatcaatttcaagaaaatgatgccgttactttccaagtattacctaaccgaaatggattagagctctttatcagtaaaaacgctgatatgaaggggaattcaaaagtaagttctgataataatacgtttaatataagtaatgaagatgatgtttcagagttcttaaagcatcagttgattcagcatgatagtgatgataacagaaaacaagcacagactaaggattctagtccggctgatttggacccatatctgaatgacccagatacacatacgcaagagtttgttttgaagttaccaagttttgaaagtatgccggaaattgcgcgcgtgctccgtttggatagtgcggcatctaatttatttaaatataaaggtgattactatttggatctaattttctttgtcgatgaatcaagtccggaaaccgtaaagaacgagttagcaattgcctatgaatatgctgatgcttcagatgttactgctgatgttttgcatgaacatggtcaagagataatgagtcaaagcgctttggaattgaccagacactatttcaaataatcaaatagaatgatgctaacttaaaagttggtgtcattttttttattttgaaggaaaattaggccttttttgacgtatcttctttttagagggggatgctgatgtttgttgcaaacgatcaagataaaagtgttttggcagccgatgcccatcataaaataacgtatacttgtccaggatgtggtcaatctgtcattttaagacaaggacaaatgcggctttctcactttgctcatcatgcaggtgccgattgtcatctatttagtgaaggggagacaaaggctcatttagccgggaaaacacgaatctttaattggtgccgtcaaaatcacctagcagttaagctagaggcttatttaccaagactaaaacaacgacctgatattttggtctactggcaccatcactggactgcaatcgagtttcaatgcagtccaatttcgtttgaaaagttagtagaacgaacacaaggctatcgatcacatggatacaaggtttggtggatcctagggccaacctatttagcacacaaattgacgttagaaaaagtttcaaaatttgcgtattttcaaaaaagcctttcgttatttgtttcgttctacgatccgcaaaatgatcaatttttgattcgccatcatcttactcaagatttatttggaaaactaaaatggcaagattatgtttttaatccctctaaaaaagcatttactgagttattccatcaaggtggaaagcagaaaccaaattttaaacaagatagctaccgtgaagcagttcttttacaacatcagttgttggggagatattcagatgcacggttaaaacgagttcagtttatttgttatacacatcatttgaatttagcaggttgcccttggatcgttcatgatcaaaattttatattaccaactgggaaaaagattccattggaagtgaaaattgaattcttattaaaacttcagctctggcaaaaacagtttgtttcgtattctttgttagcaacctggtatcgggaggtgactgaagggaatccattccaacttgctaatgtgacgcggccgcaactcaatattgaattaaacttccaacaatttttgcaaaacttactttccgaccacgttttaaaaacggttcaaaaacaatatcaaattatggtgctgccacgctggtacactgacattactcaaaaacttcgtcattttccggattaatgtgctaaagtaggtttaatttaaactaggaggaaatttgaatggcagagataaaacagttaccgaaacgtagtgatgtgccagttgagttaacgtgggatttaaccacaatttttaaggacgatcgagccgtgaaaacggcaatgacacaattgaaagtaggggtacaagctgtactaacccaacaaggaaagctacaagatagtgcccaaaatttactaaaagtgattcaagacgaactaaatgttcaaaaccaattggaacatttatttgtttatgcagagttaaaaaatgatcaagatactggggacaacacaaatcagggcttaaaagaccaaatcacgggactagtagcaaaagtttctgctcaattagcttggattgaacctgaaattttggcaattccaaatcaaaaactgactgagtttcaaaataatgaatcagagttaaaaccatatgaatatttcttagctgttttgcggttaaagaaggatcatgtgttatccgcaaaagaagaagccatattagcaggtgcgagttccatttttggttcctctgaaaaagtgtttggaattttggataattcggatttgaaatttccatttgtgaaaaattcggctggtcaaacggtacagctttcacaagggatgtattcaactttgcttcaatcaacaaaccaagtagttcgaaagcaagcttttgagcagttatacgctgtctatgagcaatttagaaatacatttgccgcaaccttatcaggtgaagttaaggtgcataattttaatgcacaaattcgcggttttaaagatgcccggcaggctgccatgagtgaaaatgccatcccagacgccgtgtatactaacctagtcactgaagtgaattcacatctagatttgttgcatcggtatgttggtttgagaaagaaaattcttaatttaaaagaaatgcatatgtacgatctgtatacgccgattactgggaaatcgccattaagctacacttatcaaaaggcccaaactgaagctaaagaagctttgcagatcatgggtgatgattatgtgagtcatgttgatgaagccttcaaaaatcgctggattgatgtagttgaaaatcaaggaaagcgcagcggggcatattcttcaggtgtctatggtacaaatccgttcatgttgttaaattggcaagatgatttagacaatttgtttactttggttcatgaaatgggtcatagtatgcatacgtattacactacccacaatcagccttatcaatatggcgattatgcaatttttgtggctgagatagcctccactacaaacgagaacattttgacatcatatttattggataagtatgatgatccacaaattaaactctatgttttgaaccattatttagatgacttcaaggggactgtttatcgtcagactcaatttgctgagtttgaacaatttattcatgaagcggatgcaaagggagagccattaacggccgaaatgatgtcaaattactatggtgatctaaatcatcgttattatggggatgcagtgattaacgatgatcaaattaaatctgaatggacacgaatcccgcatttttattataatttttatgtttatcagtatgcaacagggtttgcagcggcttcctcactggcaaacgggatcacaacacatcaggctcatgcgcgggaaaattatttaaactatttaaaatctggtagttctgattttccactgaatgttatgaaaaaagctggcgtagatatgactcgaaaggcctatttagaagacgcctttgcggtttttgagaagcgtttaaacgagtttgaaagtttgttataaaaataaagagttttccaacaatagcgattttatagccgtaattgttggaagactctttatttaataagtacctgatataagttatagaacatggggaaatgcgatggatgcatgggaaaaactaatggaatccgccaggggacattcggtatcttgacaaatttgttgtaggatactgtcattgaagtcctcaaccaaaatcccacaatcatcaccatcgtcattgaaaataacggcggaaggagaaactaaaacattcatttctgaagccgtttgttgatcagctttgaaagaatcctgtgctaattgtgaacgccggtcggcttcaaacatctccatgtcaaggttggcaatttgaccaatttttgtacccaaatttttagagtagcaaatattttttgtggtgatttctttttgaattaattttaagaaattacgtccatgacgcttacattggaataaagctgccttataatcaaggattacatgatacatatcctcggataattcgttgtaagactgataacttgtgttagcttcactgtgaagatagttttgcacaatttgcatatttaacatgggaataatctggaaactaaccttttgatccacgttatgaacaaagtccatcataactttttcagattgcatacactgttcaccccatggtgtcacgaacaaatagacgtcaagcattgagttttcctccatcaaaactaatttcagtttttaattttttgtttaagtatttataaaagacaacaatataaactttaccaaattttgaaaaaatatcaaacaaattgttttcagtaatctaaattcagctgtatcttagcgcattttaactggaaaggtaaagaaatctgcccttaataatagattagaaatgaagaacagcgtttgagcagattaacaatgacttttatgctaaaattaatagtagtgttttaaaaagtgaggcaagatacgtgattgataattgggaacagttcttattaccatataaacaaaccgttgatgaactgaaaattaaattacgcggtattcgcaaacaattccaaaatgatgaccaacaaagtcccattgaatttgtaacaggacgtgttaagccagtttctagtattaaagaaaaaatggtgcgccgtcaggttagagaagatcgattagaacaggatatgcaggatattgccggtgttcgtgtcatgtgtcaatttgtggaagatatctatcaagtggtggatttacttcgaaaaaggactgacatgaccattattgaagaacgcgattatatcaataacgaaaaaccaagtggttatcgctcataccatattgtggtggaatatccagttcaattgatttctggggaaaagaaaattttagcagaaattcaaatcagaactttagccatgaatttttgggcaacaattgaacattctttgaattataaatatcaaggagagtttcccaaggaattgagtgatcgtttacaaagagcatcagaagcagcattttcgttagacgaagaaatgtctgaaattagagaagagattcaggaagcacagaaactattctctcgtgaacgttcagaccataatatgtatggatcacataaggactgataaaaatgaaagtagctgtttatagtaaacaagcaaataatgcacaagatgtagcagataaactaattgaaaaattaaaaaaaaaccatattcctattgatcgtgaacgaccagatattgtggttactgtaggcggtgacgggacgttgttatccgcatttcagtactatcaaactcagttggaaaatgttcgctttattggtgttcatactgggcatttaggcttttatactgattggcgtgactacgagcttgatgacctaatttcggcgattaaagctgataacggggaatgtgtgggttatccaatcctagatattgatgtcactatggttggtgaaacaataccaattcgttatcatgcggtcaatgagtctacaatcaaaaaagtttcgtcaacgctagtagcagatgtttactttaaagatcgtttttttgaacgctttcgaggtgacggcctttgtatttcaacaccaactggatcaacggcctataataggtcagtgggcggtgcagttgttcatccgcaactagaagtgcttcaaatggctgaaattgcatccatcaataatcgcgtttttagaactttaggcgcttctattattttagcacctgacgaatggattacattacgtccggcacatggtggggactttaacttcacagctgatcaagttaatatatttgatgcaccaattgaacaaatcaaataccgaattggagaacaaaaaattaattttgccaaataccggcatactgatttttggggtcgcgttcgaaacgcatttattggagatggcaatgaagtttaattggcaagtaaacgtagaaagtccggagaagatccgaacttttttatatcaaaaaggcatttcacggactttgttaaaaggaattaaatttcatggcggcagtatcgaactgaatcataaaccagcccgagtgattgaaaaggttgacaatggagatttgctcactttattccttcctccagagatttcaaatgagcatgtctcaatttcaaatgagccgattgagatttgctatgaggatgatcattttttggtggttaataaaccagcgtatctggcgacggtgccttcgcatctatatgccaacgacactttggtaaatcgtgtaaaaggttattataaacgacaaaagtatgaaaacttggttactcatgtagtgacacggcttgatcgagatacttctggattggtcatttttgcaaaacatcattttgcacattctgtgttagataaagaactcaaaaagcatcaaattaaaaaaatttatattgcgattgtacagggccacatgcagcaaacacatggcctcattgatttaccaattgcacgtgaagaagggtcgtttattcgtcggcaggttgctatgttaggaacggggcgccgttcggtaactgaatattgggtaaccaaatcattgagagatgcgacactgcttcgtgttaggttacatactggtagaacgcatcagattagggttcacttttctgccctgcatcaccctttggtgggggatgttttgtatggtggaagttgtagtggttatatgcaacgtcaggcgctccattgtgcctcagtttcatttttcaatccctttttaaatcggcaaattacagtttcagcaccattgccaagggacgtagtcgcctatttggaacaagaatctcgtagacaatagtgtcgaggaggacgaattatgacggaagaactcgaacaaattaaagtggctttagaggctaccttaaataaacggagtcgaaaaaagtttcgtagactatttttgagtttacatggctacgaacaaagtcaagtttttgccgaatttgatgtcatgcaaagaaagttaatttatacgtttttaacacctgaagaattggcaaatgtttttgatgatactgaagaagatcccgttgaagctagtaagtatttggcagaaatgcctttaccttacgttgcacgtttattgggcgaaatgtataccgataatgtggttgatattttagccgaaatgagcccaattcaacgacgtaaatacttaaatttgctacgtggtgatgaggcaaaacaggttcgtgatttgattcattatgaagatgaaactgcgggatcattgatgacgactgagtacattgccgttactgatcagcaaacaatcggtagcgcaatgcaacaagttaaacaggaggctcaggatgctgagctgattacttatatttatgtgattgatgatcaaggaattctagtgggggttctctcggttcgtgatttaataactcatcaagacgatgaaaaaattgctgatattatgatcacgcgtgttttggcggttgatgttaacgagggccaagagaccattgctgagcaagttcgtgattataactttgtagcgataccagttgtcaatgcggccgaaaaaatggtcggaattattacggttgatgatattattgatgttattgatgaagaatctgccgaagactattctcgtctagctggtgtggataccgagagtatctcccataatccgttccagaccgcattaaaacgattaccatggctaatcacacttttgtttttggggatgttgactgcaactttaatcaatcactttgaaggactgttatcggaagtgagcgttttggcaatcttcatttcgttaattactggaacggcaggaaatgcaggtactcaaagtttagcggtcgctgtgcgccggttagcaactaataaccatttgaaaatttggcggctaattctaaatgaagttgcaactggtattatcattggtgtgatcacaggcatttgcgtttggataatggttggtctttggaaacagaatcttttgttgggtggcgttgttggagctgcaatggcaagcgcaatttttgttgccaatctagcaggaagtttgattccaattgggatggaaaagctgggtgtggatccagctgtcgcaagtggaccatttatttcgactcttagtgatttgaccagtgtattaatttacttcaatattgcacaatattttttgaaaatgtttgttaactaaaaaaatgtggacagttcatcgatttctcaatggattgtccacatttttttagttcgcttaattttaaagaacgccaacgatgcgtgtaccatgagcttcattaacgcttaattcttgtgtgacatctcttacattttgtgctgtaattccgccaccaggaagaataattaagcggccattagcttgcttgattgtttgttttaaatttgtatagttatcagtaattgccgtgtctaatgctccaccgtgggttaaaattcgatcaattccggcatctgcaagccaatcaatggccgctgattgcttatccgctgggatcgcatcaaaagccatatgaaaggtaatctgcatgccacctgctgccgcaattaacatttctaaggcatcggtgtctaggctgccgtctttgtctaaagcaccaaaaacaacaccgtcaacacctaattcttgagcctgaaacacatcagcttccataattttgagttctgtgtctgtataaataaagttaccgccgcggggacgaatcatggccattacgggtacatggtgttcactggcatacttttgagtttctgccataacgcccttgctgacggtcgttccaccaactgctaagttgtcgcatagttctaatcggttggcgccagatcgaattgcagatggcactttggtgaaattttctaaagcaacttctttaatgatcattgttaaactccttgaattggttttagttaaataaaacgcaaacgccttctggaaccgcaacatctttttctaatagactaagttttccagtttcttttgatcgtgaaaagagggttgcattgtcagtattttggttgacacaaaccacaaagctttcacttgggtctaaagaaaaatcgcgtggaaaactaccttcgaccgaaatgttttgaattaaggaaagggaaccatcagaactaattttgaaaacagctaacgagtcataaccacgatttgaaacatagacaaaatggtcatcagaactaattttaatagctgcagcaccgttatgagcgtcccaggttgctggaatggtactgattgtttgaacgtgactgaatttacctgtttgttgatcgtagtctaagacttccactgcactgccaagttcaccagctaaataggcttttgaaccatgatgagcgaagacaatgtgccgagggccaaatcccgcctttgttttgtaacgagcaatttctgatagcttaccatcatcagaaacatcataagtataaacttcatcagttcccaaatcacaaacgactaaacgattatccggagttaagtcgctaaaatggacatgagcgccatcagcttgttcaggtttaggacctttaccggtatgagtgaccacatcagtttgctgcaaagtgccatccgcttggatcttgtaaacggttatagtagccaaatggtaattggaactgtatacaagttgacgtttctcatcaaccgacacgtatgcaggagaatttcctggggtaaccgcatgttgcacaacttcagcaggttcatggttaagatcaatagctgccaaaccaccatctgtttgtttttgatcaactgtgtaaagaaaattacgattagattttgcgacgtaggttgggttaccaagtttggcaacaagttgcaaatctttaagtgatttagattctgtatcgagggtcattttatagacaccttgacttgatttttttgtatatgttccgatgaaaaatgattttttcaaaataaaggcctccttatatgctctaatacaaaattatagcacattttgaaaaatgactgcgtgcgcttccattttctttatatcacgattgggactatgctacaatgtaagcaacaattgattatgaggagagggtaaatatgattacgtctgaagttattgaaattggacctaatgcgattgtggaaaacgatccgttagtcattttatttggaccagaggcgacaagcaatttgaaggatgtggctgtgattcaaaaatttgcaaaacagcctttagagctcaatttaagacgaggatcacaaattaagattcgtgatcatacttacaaagttactttttgtgggaagttggttaatgctaatcttcaaggggttgggcatgccaccctttgttttgaacctgtacctgatacaccattagaaagtgccatatatttgtcaccggaaaagttcccaggattttccgtaggtgacaaaataacctatatctcttaaggatcgcgtggtgattttcttgaaaacaacgaaagataattggcgtacttggtttaccaaattagttttaaataatcgaattgtggttaatctcatgattattttactgttgctgttgattatccaggttttttctaaagtgacttggttcttccaaccgataagtgattttgctgatattgtgggattaccaattgttttagctggggtgctgttttatttatttaatccactaattgattgggtggaaaaaaagtttcgtattaatcgtgtctggacgattagtgggttgtttgtggttatcattttacttctagtctggggagttgtggcgttaattccggtggttcgcaatcaggcaacggactttctaaaaaattggccggactattggaatcatttggttaatcagttagaaacttggttgaatgatccacgaatgggacaatttcaaaaagaatttgatcaattaactaagtccactaccagttcgttttctaaatgggccagttcgattgctaatcacacttttacgtcagttagtggtgtaattagttcggttacaaaaattatcgttgggttaattacaatgccgtttattttattttatttattgaaagacggtcatcgattacccaaatatttagcacattttctgcccatccaaaagaggaaaggatttatcgagcttcttgatgagattaatggaaaattgagtggttatatccgtggtcagctaattgtggcgttttgtgttgcagtcatgtttttcgtgggatacgcgatcattggactaaaatttgcgctaacgctaggaattgctgcaggagtcttgaatttgattccgtacctgggatccttccttgcaatggttccctcaattgtattggcagcatttatttctccatggatgttagttaaagtcttgattgtgtttgccattgaacaaacaattgaggggcggttgatttcaccgttgattttgggtaccaacttggctattcatccagtcactatcttaatcgttttactagcttctggacgaatgtttggggttttaggagtcatttttggaattcccgtctatgcagtgggtaaagttgttttaacgcatttgtttcgctggtataaacgtcaaaatggtggatatgaagaaaagacttaatttgtagacttaaacgggtttgaccaaaaacttgtttaagtctttttattcggatcggacctcggtcacgaggcgtggtatatttaaggggcagattttaaccagaacatgaatttgagaggaaatcgttttgaaaaaaagagaaaaaggattgcaatttatcgaacagcatctggatttgtttcagtgtcccgtgtgtcaatgcggatatgaacgggtagaatctggaagtattatttgtccaaatggccatagcattgatgtttcaaaaaaaggtactttatattttcttaatcatgccgtaaccagtgaatatgattccgaaatgttggcgtctcgacggcgcattttaactgctggtttatttgatccaatttgcgaggaattttctcggtatatgggagaaaatgaaatgattttggacattggttctggggagggaacgccattaaaaagaaccttgtccttacttaaaaatgcaacagcaattggttttgatatttcaactgcgggaattaatttagccacccaactgaatagtgaggcgtttttctgtattgctgatttggcaaacttaccgtttaatcgtgcgcaatttacgacgattctggatcttttttcaccctctgcctattctgaatttcaccgcgtgttaagacctggtggtcaagttttgaaaattgtgccaaatgccaattatttaggtgagttgcgccagttgttgtatgataaatctagtcaacatgcagtttatcaaaatgatcaggttgttgacttatttgaaaagcactttcctaatgcgcaaagcaaacggctcacttatacttttgaatttgacgcggatttactttctgatttgattcaaatgacacctttacattggggtgctactccagaaacaattaaaaaggccaaaaattcaaaactcgatcatattacagtggatgtgacattactaaagggagtcacagcctaagttaaagggatttgtgagtttgcattatccatttgttggtgttaatatttacttaagaaatcggttgctgtttgacatcgagagatcgttggcaagccgcaagttgtacttcatttaacgtagaagctcgccgtgcctacaccgagtgtctacgctttttttgttgtttagagaaattcatagctgtatgatagcttttgagtagctaataattaatgagagtgagataaaaatgacaaatcatattgtgctttttgaaccattaatgccttcaaacactggtaacattgccagaacctgtgcagggacagattctgtgcttcacttaataaaaccgcttggcttttcagtagatgataagcatctgaaacgcgcaggattagattattggaaagatgttgatctggtataccatgaaaatcttccagaatttattgaatcagtaccagatttaaataatttatatttggtttctaaatttgcagatcatgattataccgatgttgattattccgatagtcaacaagatcattatttcttgtttggcaaagaaacgacaggactacctgaaccttttatgcgtaagtatccagaaaaagccattagaattccgcaagatgatgaccatatccgtgctttaaacttgtccaatagtgttgccatcgtgatctatgaagcattgcgacaacagtcgtttccaaatttacaacgggttcaccagtatgaaaatgataaactcaaataaaacgttgagttagccttaaaatttactagaaaggaggatcactagtggctgcaaagaaaaaatcaacgaatcgtcgaaaaagaagacgatcaagcaaaaaaaagtggcaaaatttttttgagtctaaatattttttaggcggtgtctttgttttactatctttaattggctatttctctctgggttatgtgggcattttggttaccaatatttttcggttatttgtgggagatacttttcaatttttaattgtggtatttggactctatggacttatcctattatttaccggcaaagaaccgaaattgaagggacacgttcattatttgacgggtcttggcctggcctatctgggagtaattctgattatgacaactcgtttctttgaacaaactaatcagcataatcacttcattgtgacgacatggcatgctttagaggacgcatttaaatacgcttcaattggtgaaccggttggtggtggaatcataggtagcgtcctgtataccataactgatttttgtttttccgaaattggtagtttgtttctaggcggtctcttagtgatactgggtgttgcaattttcttcggtattccaatggataaagtgttgcaaacaattgctgtggcagtaaagaaatcagtagttactcttaaagctggtttaatgcatggtggggaagctattcaaagttggtggaaccatcgagaaaaaagatcaaaacaagttagtgacacccctaaatcattaccaaaggctcacggaacgggcaatacgatgactggtaaagagttaatggcagaacaaacacctgttgttaaggaaatcaaacaaccggatattcgcattgcgtctgagcatgaacaaccaagggctaaaaaagaacctgtgtcggaagttaaggacgaaacagcttttcaaaatactgaggaattagctaatcccaattataaattgcccagtccagaacttttgacaacaattcctaagaccgatcaaagtcaggaatataaaacgattcaaaaaaatacaaagattttgcaacaaaccttaaccagttttggagtgaaggctacggttaaaagtgttagtttgggtccttcggttactgaatatgagttacacccagatattggtgttaaggtgagcaagattgtcgggttggcggatgatattgcattggcactagcagctaaagacattcgaattgaggcaccaattccaggtaaatcactaattggaatcgaagttcctaatacagagatttcaacggtttctttcagggatattattgaatctcaaccggcgcacccggacgcaatcctgcaagtgccaattggtcgtgatgtctccggaaatttagttttggcggatttggttcgtatgcagcatttgttaattgctggagcaactggtagtggtaaatcagtcatgattaatgtgatcattacaagtcttttgatgaatgctcgaccagatcaagtgaaatttattttgattgatcctaaaaaagtggagttgggaatttataaggatattccacatttattgacacccgttgtgacagatccgaaaaaagcagcacgagccttgcataaggtggtggccgaaatgcagcatcgttatgatctgtttgccgagagtggccaaaagaatattaagacttataatcaatatatttccgaagaaaataaaaaagatggaaaaaatcggccacatttgccatacattgtggttgtggttgacgaattagcagatttgatgatggtggcacaaaatgcggtagaagatgccatcattcgattagcacaacttgcacgagcggcaggaatccatatgattattgcgactcagaggccatcagttgatgttgtgactggactgattaaggcaaatgttccatctagaattgcatttgctgttgcgagtggcacagattctcggacgattattgattcaaatggcgctgaaaagctgctggggcgtggcgatatgctttattatccaatgggaaagagcaagcctgagcgggtccaaggtgcatttgtgtcggataaagatgtgaaggccgttgttgaatttgtgaaaaaacagcagaagttttcgtatgatgatgcgttgattgtgacagacgaggaagccaggatggatgagcagtcaacaagtaatgaaaaggacgagttgtacgatgaggcagttgctttggtgacggaaatgcaaaaggcaagtacctcgatgttgcagcggaggtttagaattggttataaccgagcggcaagaattatagatcagctagaggcaaatggtgtcattggtccgcaggatggtagcaagccacggcaggtgtttaataaaaaagagtgagcgagataaaacgataagccacaaaatatagcgttgcaccgaaggcgggagaattcccgcggtaggtgtggcgctatattttgtggcttatcgttttatcgagctgtcctgagattagcgaaaaataaaaaatgaggaataccaattaaatggtgttcctcattttttatcctaataatccaagtgaagatatagctgttaaaacgactgaaccaaccatactaataatcataatccaaaccacaatcatcgtaactctttgaaatgtactcttcttttttttcataaggcaccactttccgaaatgttactcactattctaacgtgttcattttaacttttcaaatttttttcaaaaatatcaaaagatcaccatttttgattggttttactttaaaattttaaaaaaatccccaccaatcatccaccaaagtttatttttatttatgaatgctgttatactagtaattacaaagaatattttgataaatataaaaacgcttttttatcataaatataataaaaattaagcattttaaaatagttttcgaaattggtggtaggtagtggtacaaagtggtaaactaaatttgtaatcgagaggaaaggggcaattagtatgttcatgggcgaatatcaacattcacttgataccaagggacgactaattgttcctgccaagtttagggaagatcttggaactgattttgttatcacacgtggtttagatggctgtttgtttggctatccgctggcagaatggcaacacattcaagataatctaaaaaaattaccgttgaacaaacgaaataatcgtgcttttgtacgttttttgtttgcagatgcaacacaatgtaattttgataagcaaggcagaattaatattccgaaacaattacgtgaacatgcaaaacttactaagaaatgtgttttagtcggtgtatcaaatcgatttgaaatttgggatgaagcccaatggaatgaagtaactgcagatacagaagaaaattttgacgatattgctgaaaatttaattgattttggcttgtaggagtaagaaaaatgagtgagtttcaacatacaactgttttactaaaccaagcaattgacgaattaaatctcaatccagatggtatttatgtggattgcacccttggtggtgggggtcacagtcagttgattttaagccaattaagtcaaaagggtcatttgtatgctttcgatcaggatgttgcagcgattgaatataatcaaagtcatttgaaagattatttagatcgtaatcaagttacttttattgaagataattttaaaaatattacaaaagatttggcagagtatggcgttcaacacgtggatggcattgtctatgatttaggagtttcatcaccccaattggatgacgctagtcgtggtttcagttatcaacacgacgcaccacttgatatgcgcatggatcaatctgctgaattaaccgctcaaattgtggttaatcaatggtcatatgaatcattagtgaagattttctttcgatatggtgaagaacgctattctaaacaagttgctcgtgaaattgaacgacaacgagaaattgcaccaattcaaacaactggcgaactagttgaacttataaaaaaagcaattccggcagctgcacgtcgtacaggaggacatcctgcaaagcgggttttccaagctattcgaattgcggttaacaatgaattaggtgttttggagacttctttagagcaggccttggatctgttaaaggttggcggaagaattagtgtgatcacatttcaatcattagaggatcgattggttaaaaatatttttaaagaacaagcaaatttacctgaacttcctcagggtttgccagttattcccaaagagcttgaaccccattttaaattggctacccgaaaacccattttacctagtgaggacgaattggcacataatcatcgcgctcatagcgcaagactccgagttattgaaaaaataaaatagggactgatttataatggcacaaaataatttagcagaagcatttccggcgagtaaacccgtaaaacgaagtataccggatcttaaagaagggactctacataaggcaaaagctgtcgtcattccaaagtctttgccattttcaaaattcgagaaaattttaatgacattctgcggtataattttgacaggcttaatgatttttgtagtttctggtaaaattgcattatcaagcgctgaacataatttatctagttcgcaagagcaagttacgaaagttacttctgataacagcaatttgaaacaggaagtgaaccagctttccagtcgtactcgcttaaacaaaattgcgaaacagtatggattaagcctgacaacttcaaatataaggaatgttaataaatgaacaataacgaaaagcgttcaaaaaaggacgataataacaaatcaagccacaatcgaagagcgttcggtcaatggctttttttcatagccattgccctcttcgtgatcttaattctacgtttttcctacattgcaattggcgggactgtagaacacatcaatttgagttcacaggcccgtcgtttatatacagataataaagtgctcaaagcacagcgtggatccatcctcgacgcatctggtcagccaattgcggaggatactagcacatactcgatttatgcagttttgaataaatcccaggtgggtgccaataagaagccactctatgtcactaataaggctaaaactgctaagattttggcaaaatatttaccaatttcaaaaaaagaagcccttaaagcgttaaatccaactaataagaactcgtttcaagtagaatttggaacggcaggaaaaaatatttcggtagctacgaaagaaaaaattgaatcttataaactgactggtatcaattttattcaatctgaagctcgactttatccaaacggtacttttgcttcaaatttgattggaattacggcgtcggttcagaagaagagttcggatattacccaattaaaaggtgttatgggtattgaaagtgcctttaacaaaaaattaacgggaactgatggggaacgatccattcaaaaggataaatttgggtatcagttgccttcctctcaagaaaagaaagctgcagttgatggcgaaaacatttacacaacgttggatacccgtttacaaactttacttgagtctgaaatgacaaaggtccaagcacaggtccatgctaagtctatgacggcaactattatgaatgccaaaaccggtgctattttagctacatcacaacggccaacatttaatcccacaactaaaagtggcattagtaaagcatggagcaattcaattgttcaagacacttttgagccaggatcgaccatgaaggtatttacggctgctgcggccattgatagtggccattttaatgctaaggaaaagtataaatctggaacttataaaatagatggtcaagtcgtgccagattggcaaacctcaggttggggattaattacctatgaagaaggctttgccctatcaagtaacgttgcgatggcccatttggaacgtaaaatgggtgcaaagacttggaagaagtacattaaaaagttcaaattcttgcaaagcacaaattctggcttgagtggtgaagcgaagggaagtatgcagttctcttacccaattgatcaggctgatactgcttttggtcaaggaatagatgtcaccacgatgcaaatgctacaaggattcacggcaattgcgaataatggtaaaatggtaaaaccacaatatatcaaaaaaatagttaacagtaacacaggcaaggttacttaccgaatgaagacgaaaactgtggcacatccaattagtagttcaacagctaaagaagttcgtaaattgatgcaagatgttgtttataagagttatggcattggctccgattttaagctatctgggtaccgtgttgcggctaagactggaactgctcaagtcgtgggatcaaatgggacatacttgaatacagatgatagttatctatattcagttgttggcatggttcctgcaagtaatccaaagtacatcatgtatatcacaatgaaacagccaacgttgcctgctacaaaaacggcaactcagcttttggatgaaatcttcagtccagttatgaaacaagccttaggagaaaattcaactacggctaagaaccaattaaccggaaaagcaaaaattgcaaatatggttggcgaaactgctgatacagctaccaaacaacttggcaaagaaagcatcgcggccacggttttgggaacgggtaatactgtgactcgacaatcagtagctgccaatactgaaatgctggccggtcagcgcgttattcttgtgacaagtggtcagatgcagatgccaaacatgtcgggatggtcacgtaacgatgtgcttaagctaactaagttagttggtttacaggcagacttttccggaaccggttttgtcaagtcacaatcgataaaagccggtgcgactattcaaagcggacaaactttgacggtaaaacttaagcaaaagtaagagagaatggagtttactatgaattcgatagagcagattggaacgatacttgtcagtttcttaataacggtggcagccatgccgtcgtttatcaattatttccgtagtcgcaatgagggccaaatgattcgtgaagaaggtcccaaatggcacgaaaaaaaatctggaacccccacaatgggcggattgatttttatagtagccatcagtctgagcagtttgctttttgaaattgtaagtcatcaaattaatgcaacaggcgtaattttgattgtaattttgattatgtatggttttcttggtttctgggatgacagtatcaaactaatgaaaaaacaaaatgaaggattgaaagcttggcagaaatttttaggccaggttgtgggtgctgttatcttttattttgtgtatgttcacgaaggttttgcccaagtacttaatttaccttgggtaggtggctggcatcttggtgcttggtttgcattgtttgtcatcttttggttggtcggtttttcaaatgcggtcaatttatcggatggtcttgatggtttggtgagtggactagcaatcattgcctttggcgcgtatgccattattgcggcggtgcaaaatcaatttgatgtgcttatcttttgtttagccatcattggggcattgcttgggttcttcatctttaaccataaaccagctaaaatattcatgggtgatatgggatctttagccttaggtggtgctttagctgccgtctccatcttagtgcatcacgaagctgccttgctgttaattggggttgtctttgtttgtgaaacagctagtgtcatcttacaagttgcttcgtttaaacttaccggtcatcgtatttttaaaatgagtccaatccaccatcattttgaaatgttgggttggagtgagtggaaagtggatatcgtgttttggtgtgttggcttaattggtgcgatgattgcattgattggcattcttaactagtttagatttttgaacgcattctgctacgtcctcaaaataataaagtttgatttgaagggaaagagtcatgaaggatattacagactatcaagataaaaagatattggtattaggattggcaaaaagtggggtgagtgcagcccgattattacagaaattgggagcattagttacggtgaatgatgccaaaccatttgacgagaatccagatgcccaggaattgttagaagatggtatcaaagtggttacaggtggtcatcccctaactttattggacgaaggttttgaactcatcgttaaaaacccaggaatcccatatacaaacccaatcattaaaggcgcactcagcaaaaaaattccaattatttcagagcccgaacttgcgtatcaagttttaagtggtgaaatgatcggaattaccggaagtaatggtaaaacaacaaccacaactatgattcagctgatgcttgatgaaaaacgtcctgctggacatgcttatctggccggaaatattggtattcctgcaactacagttgtgcaaaaaattcagtctcaagatacgatggtgactgagttatcaagctttatgttggccagtgtcacgacactcaaaccccatattgctgtaattactaatatcttttctaatcatttggattggcatggtacccgtgaaaactatgtgcgtgataaaatgcacattactaaaaatcaaaccgaaaaagattatttggtgattaactgggataatccagaatggcaacacttaagcaaacaaactaaagctcaggttgtcccgttttctcgacaggatttaactgaagatggcgcctaccagaaaggcgaagatctttactttaaaggtgaaaagattattgcggcttcagacataaaagtacctggtgtacaaaatgttgaaaatgcgttggcggcaattgcagtggctaaaattgaagggcagtcgaatgagtcaattgtccacgtattagaaagctttggtggcgttaaacatcgcgttcagtacgtcaccacttggaatgaccgagatttctacaatgattcaaaagccaccgacattgaagctactcaagttgcgctacgttcatttacaaaaccaatcgttttaattgctggtggattagatcgtggctatacgtttgaaaagttggaagctgattttaaagcccatgttaaagccattattttagttggccaaacaagtagcttgctggctgagactgcaaaaaatgctggggttcccgtaattgagttcgctcacaaagtgttggatgctgttccgcttgcatacaaagcaagtgatactggggacgtggttttgttatctcctgccaatgcaagttgggatcaatacaaaacgtttgaagttcgtggggatgaattcattaacgctgttcaaacccttcaaaacggaaagaaggcttaaacaatgcgattaatgatttcgggcggcggtactggaggtcacatttatccagcattggccttaatagaagccttaaaaaaacgcgaaccaaattctgaaatcttgtatgtgggaactgaaaaaggattggaaagcaaaattgtacccgctcagggtattgcgtttaaaacgattaaaattcaaggtttcaaacgatcgttgtccttagaaaactttaaaacgattggtctgtttttgaaaagtgtcggtgatgcccataaaatgattaaagaatttaggcctgatgttgttgtgggaactggtggctatgttagtggggcggtagtttttgctgcgagtctccaaagaattccaacggtgattcatgaacaaaatagtgtggtaggtgttaccaacaaattcttaagccattttgtaacaaaaattggaatttcgtttgaggatgcccgttcgcaatttccaattaaaaaagttgttttcactggtaacccacgagcaactcaagtcgcgttaatgcaaccaaacgatgcacttagtgagtatggattaagaagcaatcttcctacgttactaatttttggtggtagtcgaggtgcagaaagaattaattcagcaacagtcgaagcactcccacagcttaagcaaaaagactatcaggttttgtttgtcacgggtcaggtacactaccaaaaaattatggctgccatcaagccatccgatttaggaagtaatgtagtggttcgaccatacattagtaaaatgcctgaattgctaccaaactttgaggcaattttaggtcgggcgggagcaactagtatcgctgaaatcacagcgttaggaattccttcaattttggtgccaagtccttatgtaaccaatgatcatcaaacaaaaaatgcgcgaagtttggtgaaaaagggtgctgctgaattattacctgaggttcacttagatgcagattcattagtaaaagctaccgatgaactcatgaccgatgaaaacaaacgtaaaaaaatgggtgaagcagctaaaaaaatgggtcgcccacgagcagcagaagatcttttgaatgttttggaatcggtgattaaaaaatagaaaatggggtggcgatcgtgtttagaaaaaagaaaacgaaaactcctcagccaaaacgggaattgactccctgggaaaaggtacaacgtaaccaggaaattgagaaaaagaaagcagaaaaagaaaagaaaagatcgcaaacttttgtgccaaaattaaaggcaccacaaaaattttggatttggtttagctgtgttttaattttgatcttaattattgcagggtacttactttcacctcttagtcatatacagtcgataaaagtgacaggaaataaagaattttctaagacgcaaatcatgaagatcggcaatgtgaaaaaagatgattggatttttccctatctttttggacaacgaaacaaatcgacgtcagtttataagaaacaacctaaacttgtaagttacaaaataaaacgccaaggattcaatcatttaaaggtaacagtgaaggaaaattcaattgctgggctagttttgcgaaataagtattactacaccattttagataatggaaaggtaatcaaaaagtcaaaaaagcaaccgtccagtgattatcccgtttttaaaaactttcactcagcgagtgtattaaaaacgttacttacacagttccaagaattaccttcagtggttcgcactggtatttctgaaattgattatgtgccaagcaaggataatcccaataaactgcatctttatatgaatgacggcaatgaggtttatgcggttttaccaaccttcgcagaaaaaatgaagtattatccacaaatggcagcagatatgaaacaaaaaggagttatcgatttagaggtgggggcttactcttatcctttcaagaataagagtaaggaaacggcaactagttcgtcgtcttctagttcaagcccagtcggtagtggtagtagttattcgaccacctctagttcaagctcgtcgggacaaacttattctgcaacgagtacgacaagttcagtaagcacttccagtagtgttgcaagtacaaattaaacgagtaatgacccaaaatgaaaaataatgtgtggattagcagtattttttgaatttttaggttttttactcatttttttaaaagaattgactatttaaatacattgaagttatggtaaacttgagagtatatacaaaggtctaaaatagggtatgtttaggaggttcctttattatggataattcaggaatttatgttggacttgatataggaaccacctcaataaaagtcattgttgctgagaacgtaaatgagcaaatgagtgttattggagtgggaagtgaacgctctgatggaatgaatcgtggcgtgattgtcgatattgacaaggcatcagcagcgattaaaagagcaatttcagttgcagaaaataaagcaaatttaaagattcatgaagtagttgctgggattccggcgaatttgttaaaaatcgagccttgtcgtggtatgattgcaatcgcagaaacatcacgtgaaattactaaccaagacgtgattaatgttgctaatgcagcttctgtacacagcttgccaccagaacaagaagtaattgatgttttacctgatgaatttgttgttgatggatttgatggtatcaaagatccacggggaatggttggtgttcgtttagaaatgaacggaactgtgctaactggtcccaagacgatcattcacaatacaaaacgcgcaattcaacaggctggattacatttaacagatctagttctaaatcctttagcgcttggaaaaactgttttaaatgatggggaacaagattttggtaccattctcatcgatatgggcgcaggacagacaacaacagcaattattcatgatcatcatttgaagtatacatatgttgatcaagagggtggccaattcgttaccaaagatatttcagttgttttgaatacatctttgagtaacgccgaaaagctaaaacgcgaatatggctatgcatttgccgatggcgctagtgatgatggttttccagtcgaggttgttgggcaatctgcaccagcccaaatcactgagaaatatttggctgagattattgaagcgagactagaacaaatcttaaacaacgcttataatcatcttgagaacattgatgcattggatatgccaggtggggtcgtcattactggcggcgctgcggcaattccgggaattcaaagtttggctgcagatatttttggaacaaacgtcaaattgtatgtgcctgaaccaatgggcttaagacatccagcattttcacaagcttacgctatactaaactatgaagcttcactaagtgaggttgatgttttggcaaagagcgcgatggtagcgggaacgcggacaattccagaacaacagacatttgcgtctgacgatacagatcctgcaccacaaacaaatagtgaagatgtacgtcaaacgacgaagagtgcacctaagaaaccaaaacaaaagaaagagaattctttctcatttagcggcttagttgcaagtatcaagcgctggtttagcgaattctttgactaactttaaaattatggaggaaaaagggatggaatttacaatggatgataaacaaaatgctggtgcaaacatcaaagttattggtgtcggtggcggcgggaacaatgccgttaatcgaatgattgctgaaggtgtcaaaggcgttgaatttattgttgccaatacagatgttcaagctttaaaacaatcaaaagctgaaacaaaaattcaattaggacctaaattaacaaagggattaggcgctggctcaactcctgaagttggtaccaaagctgctcaagaaagtgaacaaacaatatcttcagctcttgaaggtgcagatatggtctttgttactgctggaatgggtggtggtaccggtacaggtgctgcaccattagtatctaagattgctaaagaaacaggagccttaacggtaggtgttgtgactcggcctttcagttttgaaggaccaaagcgcgcacgttttgctgctgaaggtgttgctcaaatgaaagagcaagttgatactttgattatcattgctaacaaccgcttgttagaaatggttgacaaaaaaacccctatgatggaagcattcagtgaagctgataacgtattacgtcaaggtgttcagggtatttctgatttgatcacttcacccggttacgttaacttggactttgctgatgttaaaactgttatgtctaatcaagggtctgctttaatgggaattggttctgcaaacggtgaaaaccgtaccgaagaagcaactaagaaggccatttcttcaccattacttgaagtttcaattgatggcgcagagcaagtcctgttaaacattactggtggtccggacctttcattgtttgaagctcaagctgcttcagaaattgttgctaaagcagctactgatgatgttaatatcatctttggtacatcgatcgacgaaaacatgaaggatgaagtacgtgtcactgtcattgcaactggtattgacaagaaaaacgaccgtccaatgcatcgagcaactgcacggacaagttttgatactccggcagctacaaagagttccacaaattcaactcctgcatttaacacgtcgaatacaagtagtgctgctccaaaatcagaagaaaaaagcgctaaaaaagatgatccatttggtgattggcaattgcgtcaatcaaattcaaatggtgttcggccaacttctgttgaggatgatgatgaatttaaagatattgaaaagaaagatttcaatgtttttaatgattcagataatgatggcgacaagggtgttgatactccaccatttttcaaacgtcgtcgtaagtaattgaatatcattttacaaggactgggaacaagacaactgttttgtcccagttctttgatacagcgtcattattaggaggcgatctgtatggcattaaatgatcgatttaataaactgtttgggttggatgatgaacaagggcaacctgatactgacttcaatcagcgaacagatgttgatgacaaggtgactgcgatggataatgataatatttcggattcaaaaagccaaattgcattatttgaaccaaggatatttagtgatgctaaagaggctgcaaaacaattaatcgctggacaggctgttattttaaattttgaacgtattgatgatgagcaaaccaaacggatcgttgactttttatctggaacgttgtttgccattgatggttcaattgaagaagtgggcacacatatatttttgtgtacgcccaagagctttgaaattaatggcagtctgtactcaaatattcaaaatggagatttgagtcacgacaatataaataaggagtaaacatttggtctttttatttaatattattagtaaacttattcaattgtacatgttattgattttcgtattcgttttgatgtcctggtttccaggtgcttaccaaactaagcttggacaatggcttgctaaaatctgtatgccctatctaaaggtgtttcagtttattccacctatttttgggttggacttttcacccatcatagctatcttggttttagaaatggcacagtacggaattcaatatttgtttattatattaggttctttataaggggaataactaaaaatggacaatattatgcaacattttcgtcctgaggaagcaccgtttgtagatgaagcaacgggctggattcaagaagtacgtgatcaaaaccgatttgtgttaacaaattttcttaatccacgggaaattttcattttgataacgttagtcaatcgtttggatgatatcaaagttcaaagctttggtggatattccagagcagaaatgcaacgggcaattatttttccggattattttgtgccagaacgacaggatttcaatgtcagtttaatggacattggctatccggtaaagtttgccaaaattcatcatcgcaatgttttagggacgcttgctaatatgggcgtggaaagagacacgtttggggatatcatttctaatggcgatgagtggcagttttttgtaaaatctgaaatggtagatttctttttgtcacaggttagtaaaattggcaatgtcaaggtccgattggctgaaaaagagttaagtgatgcagttgaacctgaaaatgactgggaatcgggtagtacaacagtagcgtcagttcgagttgattctgtgattgcagagggttttcatttgtctcgtaaccacgccaaggaattattagaagaacggaaggttactttgaactggaaacctcatcaacgacctgattttgaattggtagcaaatgatttgttatcagttcgtggatatgggcgtattcggcttgacagtattgaaggcaaaaccaaaaaaaataaaattcgaattttaatttcaattattagtagtaaaaagaaaaaatgatggaggaatcagtatgtctttagatccagtagatattcagaacaaacaattttcaaataaaatgcgcggctataaccctaatgaagttgatgagtttttacaacaagttgcaattgaatatcgacgggcattagacaaaatctcttctttacaaaaagaagtagaaaatgctgaaactaaaattgaatatttcgatgatatgaaagaagcacttaataaatcaattttggttgcacaagatgcggcagacaaggttaagagtagttctaagcgggaagcagagttgactgctgaagaagctcaaaagcaggccgatggaatggttcaaaaagcgcgggttagtgcggaggctgtgattgatgagcaggctgaaaaagcaaagcgacttatcttagcaaccaacgagttacgtaaaaatgcgcgcctttatcgccaacgggttcaagttttggttgattctcaattgcagatgattaatggcagcgaatgggatagtattttaaaagaagatcaagatgtgcaggtgagcgacctgaagaatgcaatgttgcatactggaacccttgacaagatcaaagagtcaagagtaaactcagttgatgaagaagacgctcgcgatattacgccggctgttgaaccagagaaaaaagatgatgaatttcttcaggaaaaagagaaaccagctgagaattcaaccgaaacatcggttaaacaggatggggactctcataatgaggacgaagatgattcaaagaatacagctccagaaacggtagttgtctttccaaatgacaaatcagattcagaaggtcatgaaaattctggacttcatgttaatgctaaaaatgaatagattttctttgaagagaatacattaaaaatggcaaactgtcagcgagttagcgaattgatgagaggctaatcagaatccatttgagatatcatctctgagacatcaaattgacttcaggtagatttgatcggtttaaaagccgttattgaattaaggaaaacattactagtgttttcaaaattgggtggtaccacgaagacttcgtcccttatgacgaggtctttttttatatcaaaaaaataatttaaggagtgagagttaatgcgtgtaaaagacacattgaatttaggaaagacaaaatttaagatgcgcggtaatttacctgttaatgagctaaaacgcgaacaggtttgggaagaaaataaactgtatgaacaacgacaaaagttaaatgagggtaaaccaacctttattttgcatgatggacctccatacgcaaacggcaatatccacatgggtcatgccatgaataaggtttccaaagatattattgtgcgctacaaatctatggcaggttatcgttctccctatgtccctggttgggatacccatggtttaccaattgaacagcaattaaaaaaagccggctatgatcgaaaaaaaatgacaaccacagaattccgtaaactttgccgagattatgcgttgaagcaagttgaaatgcaaaaagcagacttcaagcgtttgggagttgctggtgagtgggataatccatatctgactttgaaaccagaatttgaagctcaagaaattcgtacatttggtaaaatggcggaacaaggtttgatttataaaggaaaacatcctgtgttctggtcttggtcatctgaatctgccatggcagaagcagaagtcgaatatcatgatgtcacttcaccatcagctttctttgcggaacaagttgtagatggcaaaggggtcttggatactgatacctatttggtggtttggacaactactccttggacaatccctgcttctgaaggggttacaattgatgctgattttgattattcagttgtgcagcctgaaggtgaaacccgcaaattcgtgattgccacagaattagttgacaatgtgaccgagaaatttggctgggaaaatgtgaaagttcttaaaacagttaaaggtgctgacatggatcgtgtcttaacgcaacatccattctatccagagcgtaaattagttgtcatgttgggcgattttgtgacattagatgccggaactggtttagttcatactgctcctggttttggtgaagatgacttccgtgttggtcagcagtatggtttagatattttagtacctgtaaatgatcaaggctatatgacagatgaagctggtaaagattttgcaggtgtcttctatgatgatgcaaataaaattgccttagataaattaaaggcagctaacttgttattagactacatgccttacaaacatagttatccatttgattggcggaccaagaaacccgttatcttccgagcaactcctcagtggtttgcttcagtggataaaattcgagataaaatccttaaggcgattgatgatgttaagttcacaccatcatggggtcaaaaacgtctttacaacatgattcgtgatcgtggtgactgggtaatttctcgtcaacgtgtttggggtgtgccattgccaatcttttatggtgaagatggtgaagcaatcatgaccaaagaaacgattggtcatgttgctgacttgtttgaaaaatatggttccgatgtttggtttgatcgtgaagctaaggacttacttccggaaggcttcactagtgagcattcaccaaatggtaaattcacgaaagagactgacattatggatgtttggtttgattctggctcgtcacatcaaggtgtcttggcggaacgcgactatctcacctatcctgctgatctttatcttgaaggatctgaccagtatcgtggttggtttaactccagtctaattaccagtgtagctgtttctggcaaatcaccatataaacaggtggtttcccaaggatttacactggatggccaaggtcataaaatgagtaagtcacttggtaatacgattgtgccaagtgaggtaatcaagaaaatgggtgctgaaattgttcggttatgggttgcttcagtcgattcttcatctgatgttcgtgtctcaatggaaaactttgtgaagatttctgatagttacaagaagctccgaaatacgctgcgttatttgctagcaaacacaacggattatgatccgaaaactgataaagtggcctatcaaaatttggaatcagcagacaaatatatgttgattaaatataacaagttggttcaaactttacgcgatgattatgaaaaatatgattttctaaatatttacaaacgggttatgaattttgtgatcaccgacttgtctgccttctatctcgattttgctaaagacgtggtttatattgatcctgaaaagagtcaaagtcgtcgttcaatgcaaaccgtcttctacgaaatcttagttggcttaacaaaattgcttacgccaattttgcctcatactactgaagaaatttgggagtacttgaaagagccggaagaatttgttcaattggcagaaatgccagaagtacaacattttgccgatgaagaaaccatttttaccaactgggaaaaattcaagggaattcgttctaatgtgttgaagactttggaagaggcccgcgatgctaaaatgattggtaaatctatggaagctcaagttaacctatatgttgacaaagataccaaccaacttttaaatgatttgaacacaaatgtacgtttgttgttgatcatttctaaattagaagttgaagatttggatcaagctcctgcagatgccgatcagtttaagggaatggccgttaaagtttcacctgcgcaaggttctgtttgtgcccgttgtcgaatgactaaaacggatgttggttcagatacagcatatcctgaattatgtgcgcgttgtgccaaaattgttcgcgaaaattatccagaaacagttgaagaaggattagaagcttaattcaaaaaaataatctcatcaaaattttgtcgaatctaatttttgacaatgattgatgagatttttttattatccgttaagatgtgtgcaaactagacggtaattaatttacttttttcttaattatcagtatgatgtttaaaggagcagtctaaaatgagataatagctagactagcgaggagtgagtttcatggaacatggggtagtcaaaagttttgataaagataaaggatttggatttattattttggatgatggtacagaggtttttgtacattattctgcaatcgaaggcgagggttttcggatattacatgagggcgatgaagttaatttattagtcgtccaaggtgcaaagggccttcaggcagtcaaagtgagtttagtgactgacaacacgccgtctgaaacaccagatcaagctaaagatgaatctacaaagtaaatttaaaaaagttcgaggaataattaatgaattttgaagaaaaaattgtcaaaagtgaaccccgttacaacggagctattattgacgtttaccaacaaacagtaaaattaccaaatggtgagttagctaatcgggatgtggttttgcatcaagatgccattgctgttttagcaattacagatgacaacaaagccatttttgaaaaacaatggcgcgcacccataaagaaaacgacgcttgaaattcctgctggaaaagttgaggctggtgaatctgatgagacgactgcgattcgtgaacttaacgaagaaacgcgctatcaagcagataatttaaaacgggttgctggcttttatacaagtcctggttttacaaacgagtatatgactctttatgtagccacgggactcaaacaggtaataaccaagttgccacaggatgctgatgaaaacattcaattaatgtccctttctttgacagaggcgttagcaggggttactgatggcacaattgaagattcaaaaacagttctggctatttactactggcaaactttaaataagtaggtgaaaactgtgaaggatgacgaacaacaagacggtctgactcgtgaagactatcaaaaacgcaaacaggcagaaaatgagcagtttgaaaagcgagatcggaaacgggttcaagttgaacgagattatgctcgaacacatgctgaagacgcgtctccagaagaagagcccacaattcgaagtacagcagaacgtaaaagccgcaatttaggtaaacgtttaaactggattatttttggattacttgtggcaattgtgattgtttatttaatattattttttgtggaatgaggaatagaaaatgaagtatggcgtaatttgtgcgatggaagaagaaattaaaagtttacacagtgcattaacagtaacaaacgagactgacattaatgggattactttttatgaaggaacaattcaaaataccgaggttgttttggtgcgttctggaattggtaaagttgaggctgggatcacggcggctttattagtcacaaatttcaaagtggatgctttaatccattccggttctgcgggtgggattggtaaagaattgtctgtgggtgatgtggttgtttctacccagaccctctatcatgatgttgatgcgactgcatttggttataaactaggacaattaccaggtcaacctgctcgttttgatgcagatcctaagttagtagctgaaattgtggacgctggtcataaaacaggattaacggtaaaaaaaggtctaatcgttactggtgatcaatttattagtagttcagacaaaattcaaactattttgaataactttcctgatgcactttgttgtgaaatggaaggctgtgcaatcgggcaggttgcccaccaattcaatgtgccattcgtggtcattcgcgcaatgtcagatgttggcgatgaaaatgctggcgtgtcttttgatgattttattattgatgctggcaaacgctcagctaagatgctgttagcgttatttgagaattaaaagaatttttgaaaaatgagtaggagaattgaaatgaagcaagtttattttgataatgcagcaaccacgcccatggcaccagaagtggttaaaaaaatcacttcagaaatgagtcaagactttggtaatgcttccagtacacatgcgtttggacggaaggcacgaatggtattagatcagagtcgtcaggtgattgcagacagtattaatgccaatgaagatgaaattatctttacaagtggcggaactgaaagtgataatacggcgattatgcaaactgcaattgctcgtcaatcgcttggtaaacatatcatcacgacagcgattgaacatcctgcagttctgaaacctttagcttatttagaatcaatcggttatgaagtgacttatttaccagttgaccagcaaggtctaattagtttggatgatttaaaggctgcgttacgtgatgatacgatcctagtttctatcatgacggggaataatgaagtgggcagtcacatgccaattcatgaaattggggagatcttaaaggatcatcaagcttggtttcataccgatgcggtacaggcttatggtttgttggatattgatgttaaacgcgaccacattgatttaatgtcaacctctgcacataaattgaatggtcctaagttcttaggtttcttatacaaaagggatggtgtcaacttcccaagtttcctaaagggtggcgaacaagaagataagcgccgagcaggtaccgagaatgtgccaggcatagctggatttgcaaaagcagtttctttattaactccagaagtaaaatctgagatgcagacgaagtatcaaggtttcaaacaacaaattattgatggtctgaaacaagctgacattgattttgagataaatggtacattgaatcccaacaatttacagcatgtatttaatctttggattaagggtgtttcaacctacgtgatgcaaactaacttggatctgaatggaattgcagtgtctggtggttctgcatgtaccgcgggtagtttagagccatcccacgtgttaattgcaatgtatggaaaagagtcaccacgcattggggaatccattcgaattagttttggaaaatataatacaagtgaagatgtagattatttagttgataatttagttcaaattattcagcgtttaaaaactaaggaggctgtgaaataatggcatttacaacagaagtaaaagttgatggtgatcacgatacgtataagataagtccggaagtaaagaagtacacgttaagagacttgggcttcatcgtttctaatggaggtaactttgtgtttgaacgatctttggatccgacttctccatacaaacaaggaaacaaattacgcattatctttgctaaagatttaagtggctttaaaatgtcagtaacgacggctaatggtttgaagcgggtcaatatttttaacaaagaaaatgaccaaccacttgtggaacagtatcactacattttagatgatatggttacccgtgaagtttttgtcaaagcttagttcgaaggattatgccatagtttgagttggtataatcttttttatgtcattaaattgcgattgttgttcaacgtttcagataaaactaactaataaatagtaaatgcttttcaggatttgcttactttgttataatggtcgttactggatgttgcgaccttcaatcgtagattctccagaatctgatagaaatgatggtgattttgatgacagacaatagcaaaactcgtgtcgttgtcggcatgagtggtggtgttgattcatcagtcgtagcttatttgctcaagcaacagggctacgatgtcgttggtgttttcatgaaaaattgggatgacaccgacgagaatggtttttgtactgcaactgaggattacaaggatgtagcgaaagtcgctgcaaaaattggaattccttactattcggttaactttgaaaaggagtattgggaccgtgtgttcacatacttcttggatgagtataaaaagggccgaacgccaaatccagatgtgatttgtaataatgagattaaattcaaagcctttttggattatgccattagtttaggtgcggattacgttgctactggccattatgcaaaacttgagcgtgatgcacagggcaatcagcatttactgcgttcagaggatatgaataaggaccaaacttacttcttgaatcagctaactcatgaacaattagatcacgtcatgtttccattagggggcatggttaaagctaaggttcgtaagatcgctgagaaggccggtttagcagttgctaataagaaggattcagttgggatctgctttattggcgagaagaattttaaagagtttttgggcaattatttacctgctaaggctggcaagatgatgacagttgacggcgaagttaagggcgagcatgctggtttgatgtattatacaattggtcagcgtcgcggtcttggcatcggcggcggtagccaaaataatgatccttggtttgttattggtaaggatttaaagaagaatattttgtatgttggtcaaggctaccataatgagcatttatatgccgatcaattggttgcatctgatcttcattttgtaaatgatattgttgatcgtggtgattcattccgttgtacagcaaagttccgttatcgtgcaatggatgttgacgtcactgttcacttcaacgaggatcgtactcagatgacagttgattttgatgaccctgcgcgtgccattacaccaggccaagccgttgttttatatgacggtgaggagtgtttaggtggcgggattattgatgctgcttacagtaatgataaagttttacaatacatctaaaaattaaaataaaaggccgtttgcaattccatggggaagcgtgaacggcttttgtttactttgaattttctgcgctagactggcataatagttttagcaatagatgaaaaggaagattaagttgactaaattatattttattcgccacggaaaaactgaatggaatcaggaaggccgttatcagggtgcacgaggagattcaccactcctgaaggaaagttacaaggagattgatgccttggctaagcacctaagtttaactgcttttcgtcatatatatgtgagcccagttcgacgtgctcgtgttacgggtaatactttacaacatgatttggatgaacttcagggtcatccaacgccgctgacaattgcaagtcggttgcgtgagtttaatttgggcaaaatggaaggtatgaagtttacggatgttaaaaagaaatatccacgcgaatttgatgattttcagaatcatcccgatcaatatgatccacgggccattcaaggggagtcatttccacaacttatccaacgaatgaaaccgtctattcatcgaattacagatatctatcgccaacctacggataatgtgttgattgtcagtcacggagcagccttgaacgcgttggtgaatacactgctaggtactgatttgcaggatttgcgtaaacggggcggcctatcaaatacaagtacgacaattttagagacttttgatgctggccaaacattttcattaattaaatggaatgatacaagttatattgcccgcaaggctgacccgactgatatgatttgaggtaaacatgacagaaaaaaaagatttaaaacgcgaagcatccaaacaaaaagctcaaaaagcagcatcattgttagttcaagcaattgacgcaaaaccagatgattttcatcgctattataatttaggcgtttttttgacccaagcaaacagttttgagcaagcagaagaattgtatatgaaagctttaggacgttttcaaaagaacagtcaagcacaaaatacgttgcactatggtttagggaatacgtattacgaggctggcgagttcaaaaaagctttagttcagtttcagttggtcaaagattcatcgcttaaaagttatgcttatttgatgattgctcaaacttatgtcgcacaagatgattataaaactgctttggcatttgcgctaactgcacaggccaaacatcaacaagatccaacgatcaatgggttaattggtgagattttcttagcattgggagattttgctcatgccgagagttactatgatcaggctcttcatgccaacgaaaaaaatggcaagtatcaatttgaacgcggattaattgctttggtacagggtgaaaaagaaactgagtactttaaaaaagcaaaacaattagatccagcttattttaaaaaaggtcaacagcgccttgaagatatcgagaaatttatccaaacgcgtgatcaagatgctaaaacaaaggatgataagtaatgccaaacgaatcgcttaatttatttgatgaagattcgcaaaatactgaatcaattaaaacggaacctcagtttgtggtgggcaaagtttctgcgattttttttgctagtccggatagtttttataaagttttactggtaaaaatcagtgaaactaatttggagtggcatgaagatgaaatcgtggtaaccggtagctttggtgatattaaagaagaacaagcctatcgttttgtgggtgccacggttacccatccgaagtatggaactcagtttcaggcaactaattacgagagtgccacaccaacaacgaaagaggggctagttgcttatttatccggtgacgagttcaaaggaatcggtaaaaagacggctgaaaagattgtggcgttactcggaaccggcgcaattgataaaattattcaagatccagacgttttaacacctttaaattttaaaaaagaaatgcaagcaaatttagttgccgtccttaaagctaataatggaatggaacaaatcatcattggcttgaacggttatgggttcgggagtcagctagcagctagtatttataataaataccgtgaagaaaccctcgatattctgcacaagaatccgtatcaattgatcgaagatattgatggaattggttttaagcgagctgatcaaattgcggaagctttagatatttcgtttgatgcaccggcacggattgatggcgctattttaacggcctcgagtgacatcagtaattctaatggtgatacctatactgatgcccgttcacttttaaaaacgacgttagggctattggaaaatagtcgcaatcaggccgttgatccgcaaaaagtagccgatgaattagttagtttggctaaggatggcaaggttgttggggaagagaatcgaatttatctacgcaatttatttgaagcagaatggcaaattgctgagcacgtcaaacggttgcatgatgccaaagaaacgcacacgtttaaaactgatgaaattcaaggtgcgattgatttagcacaaaaacagtttcacattacctatgatgattctcaacgccaagctcttttaaaggcaatgcagtcaaagttgtttttactaaccgggggtcctggaactggtaaaacaaccattattaatgggattgtcaaaacttttgccacgttaaatgatttttctttagacgtcaatgagtatcatgataatccgtttccggttttattagcggcaccaactggacgggcagctaaacggatgagtgaagtgacaggtttaccagcaagtacgattcatcggatgctgggactaaccggtcgtgaaacaaatcctgaccaagaaacgaaagatcttgaaggcagtttgttaattgtggacgaaatgtcgatggtagacacctttttgtttaaaaccttgatgcgggcaatttccaataacatgaaagttattttggtgggcgataaggatcagctcccatctgttggtgctggtcagattttcaatgatttgttgaagagtgaagttattcctaagattgagttaacaaaaatctatcgacaagataatggttcaagcattgtgccccttgctcatgcgattaaagaaggacggctgcctgatgactttaccaaaaaccaaaaagatcgttcatttattgcctgttcaactagtcaagtagatagtgtcatttcacaggtcgtccataaggctgagcaaaaaggatttaccgcccaagatattcaggttttagcaccgatgtatcgggggatggccggtatcgatcgattgaatgaatcattgcagaagatcttaaatcctaaaaaaaacgcgcggaccaaagaagttgaatttcgtggccaacactttcggattggtgacaaagtccttcaattagttaatgtcccagaaaataacgtttttaatggtgatatggggatcattaaggggattatttcagctaaggacaaagataatactgataaacaagataaattagtgattgattttgacgagactgaagtgacgtatggacgcaaggattggattcaaattaccttggcatactgtacgtcgattcacaaatcacagggtagtgaattcaagatggtaattttgccaatggttcagcaatattcacggatgttacaacgaaatttgttgtatactgcagtttcccgggcagaatctttgttaattctcttgggggataaaacagccttcgaaaagtgcgtgaacaatttagccgttaatcgacggactaccttgaaacagcgtttgttaactgtttttgatggaaaacaggttgcaaaaacaaaatccgatcttttagttgcgacaaaaaaagttgtgccacaagtcgaaacagaaataaaagcgccagtcactgctaaagtagaaaaaaaatcaggggaatctgcggtacccgacactgttttaaccatcagtaaagtccaaggccaaataatcgatcccatgattgggatggcaggaattacgccgcaaagttttatgaaggcttaaaggtgttgcgcttttttgccaggactgcgataatggtgtcgggataaatttgagagttttaatggaggatgtcatgacatcagatagtgctaagcaacgcatgaaactttttacgctaaattcgaatcaaccgttagctgaaaaaattgctagagaagccggagttccacttggtaaagcgactgtcaatcgttttagtgatggtgaaattcaggttaatattgatgaaagtatccgtggggctgaagtttatgtaatccaatcaatttcagaaccagtaaatgatatgttaatggagcttatgattatggttgatgcgcttcgccgagcaagcgcgagtcaaatcaatgtggttattccttactatggctattcgcgtcaggatcgtaaggcacggtcacgtgaacccattactgcaaagctaattgctgatttgctggaaatggataagattactcgggttgtaacaattgacttacacgcagctcaaattcaaggcttctttgatgttccagttgatcatttagtggtagctccattattggccagttattttacggatcatcagattacagataatttggtagttgtatcacctgatcatgcgggtgtttctcgtgcacgaaccatggcggagttattaggaaccccgattgccatcattgataatcggaatgtggaatctagtgagtcacttgatgaaattcctactgaaataattggtgatgtaaaggggaaaacctgtattgtcgtggatgatatgattgatacgggaacccgaattactatttcggcgacggctttgaaaaatgccggtgctacaaaagtttatggttgcgcaacgcatgctattttctctaaaaacgcacctgaaattctccaaaactctcagttagagaaagttgttgtgaccgattctattcgcattgacaaagaaaaacaatttgataaactggttcaaatgtcagttggcccattagtgggtaatgcgattaagatgattcacaacaatgagccattagaaccactttttagaagctcaattaaaaactaaacattcgttttgaaagcatttctggagcagttcatctttttcgatgaatgtctaaaggaatgcttttttgctgatgccgtggttttaatatgggtaatttaatgctatgttaatattaaacatgcgttggagggatgtcttttggatcgtattctaagttttatgaaacgcgatgacgttgaattgtatacaacgttatttgtgattattcttattttatttttattgaaaccatttttgtcattgattttatttgtcgtgattttttcttttcttgggcacgtgggaactaaaaatttacgaaaaattttacctctgaatcaaccctttgctaccgttattttgtatgtggtgacaatcggtctttttgtaatgattgttagcattgcaaccccgctgttggtcgatcagtttagcggcttgcctaaactagttgaagcgacaatcgacaaacatcccgtttttgacaaacaaatttatacttgggctcaaaaggccattcataactcttctattctgaaacatagttcagatttagctttgactgggttagtaaaactgggtcatgtcggtcgtggcttagaacatgtattaatggctatttttttaagctttattttcaatttaacctacactcatttacgtaattttggccatgcttttttgcatagtcgctataatcgtttgtttattaatgtttatacgctggctgataaatttatttcgattttcggaacggttattgaaactcagctgattatttgttccattaataccattctcatgactatcggattgtggatcattgggatgccgagtttactagttctggccttagttgtttttgttttgggccttattccggttgctggtgtgttaatttcacttattccacttgcggtaattggcttttccgttaacggtctaattacggtcctagaagtattaatcttggttgtccttgtgcatgcttttgaatcgtacttcttacacccacggcttatggcaaatgctacggcactgccaatatttgtgactttcatcactttaatcgtaagtgatgaattgtttggaacctgggggttgattgtgggcattccaattgtggctttctttatcgatgtcttaggggttaatattcgcaaacagcaacccaaaaacataaagcaaagtattcattcagaaattgataattaagctttgaaaatgttttatataattaatttgataattgactagtaaaaagtgaacttttatgattgattttgaacgaaattggtgctatattactataggcaggtgaaatgaaagtgtttacagaagaaagacaacaagcaataatcaaacagcttaatcgagatggcatcgtcaaacttcaagaactggtgcaaacgttagactgctcaatttctacggtgcgccgtgatttgcaagagttagaagatcagggaaaacttgtgcgtgttcatggtggggcaacccaaattactactttgcaaagcgaaccaggtgttttagaaaagtcttccaaaaacgttcaggcgaagcaaaaaatcgctaaattggctgttcaacagattagggctgatgaagttatctatttggatgcagggacgtcgactgaagcgatgattccgtttatgacaactttaagctctgttctggtagtcacaaatggtgtgcaattggcttcaaagttagcagacattaatgtgaaaacttatttattaggtggtgaacttaaaaacaccactaaggccatcattggtgcggatgtagtcgaaacgatcaaaaactttcggtttaaccgggcattcatgggcgtgaacggggttcatcctaaatacgggtttacaactccggacccaaatgaagcggctgtgaagcgggccgttctagctcaaagtgagttaggatattttcttgcagataaaagtaaattaaacgaagtgtcgtttgcgaaagttgctgaactaggtgctggtgttttacttactgatgagcacgataaagaagttttacaagaatttgatcagacaaaaagaataatggaggctgaaaaatgatttatacggtaactttgaatccatcgatagactatgtggttcaacttccaaaattaaatttgggtgaagtcaatcgacttgaaaccagttataaattcccaggtggtaaaggaattaatgtttcacgaattttacgtgaacttggctatgccaatcaagcctggggatttttaggtgggtttacaggtgaatttgtcagtgacaaacttaatcagctaaacttggatagtcattttactaagattgcagatgatactcgaattaatgtcaaactcaaagctgatcaagaaactgaattaaatgcagcgggtccaaaaattacaaaggccgaaaagcaagtgtttgtttcccaatttgatgagttgaaagaaaatgatgtggtcattttttctggaagtgtgccaagtagtttacccgaaaccttttattttgacctaattcaaaaggttaaggaacgacatgcggaatatgcagtggatacgactggtgaggcgctcaagaaaactttgccaacgcatccagtggttgttaagcctaataatcatgagttggctgatttatttggagttgaactcaatagcctagctgaaattaaaaagtatggacaaaaattaatcgccatgggtgcgcaaaacgtcatgatttcaatgggaggtgatggtgggatgttagttaccaaggatcattgttatcgcagtgccgcgccaaaggggaccgttcaaaattctgtcggcgccggagattcaatgttagctggttttaccgggacttttgatgctactcacgatccagtggaaagtttccgttacggattggcctgtggaagtgccacagccttttctgcagatattgcgaccaaggcaaaaattgatgaaatattaccacaaattaaaatagaagaattttaggaggagagaatctcatggatattcgtgaattattacttaaggatgtcatgatcatggatttaaaagctaagtcaaaagacgaagttattgatgaaatggttcataagtattttgaacagggtgtgattgatgatgagaagttgtataaggccgacatcatcaaacgggaacaagaatccacaaccggaattggtgatgggattgcgatgcctcatgctaaagacaaggccgtaaaacgagccacagttcttttcgctaaaagtgaagccggggtcgactttgatgcgttagatgggcaaccagttcagttattctttatgattgccgctccagaaggtgctaataatactcatttacaggctttagcttccttatctagcttattaattaatccagatttagttgctaaactgaaacaagctaagactcctgatgaggtgcaacagctcttttctgatgcccagtcggcaaaagaggctcaggaaaaagcagatgctgaaaaagaatctaagacaagcgatgtccctcaagataatggtaaacgcccttatgttgtggctgtttctgcttgtccaaacgggattgctcatacgtatatggcagaagctgctttaaaaaagtccgctaaagaaaaaaatattgatattaaagttgaaacaaatggttctgaaggcgttttacatcgtttgaccgctgaggacattgccagagctgatggcgtcgtgattaccgcagataaaaaggtggaaatggcgcgttttaatggtaaaaaattattaaaccgaccagtaattgatggcattaataaatctgacgaattattagatcaaattgaagctggcaacgcaccgatttatcaggctgttgacggtgatgaaccaagtgattctgaagagggccaaaatggcggtctttggaatgaaatctataaagatttgatgaatggtgtttcgcatatgctgcctttcgttgtgggtggcggaattatcatggcgttatcatttattctagaacgttatgtgggttcgcatagtatgtacttcttgttttttaatcatttaggtaactatgcgtttgcgtttttagttccaattttggccggctatattgcggaatcaattggtgatttgcctgctttaatgccaggtgttgttggcggttttatggccaatacggcggctgccaatatcatgaaaactactagtgtttctggatttattggtggtttgttagctggtttcttagccggaattgtagtgaactggcttaaaaaggtctttaaaggggttccaagaagtttagaaggtatgaagccaatgctactttacccaattttgagtttaataattgttggtgtgtcaatgttctttatcattaatccaatttttgcagctgtaaatgtatggattacccatgtcttaaacggaatggggaccgggagtgcagtcttgctagggacggttcttggcggcatgatggcattggatatgggaggtccattcaataaggctgcttacacatttgcaattgcagcctatacatcaactggcgacggcaaactgatggctgctgttatggttggtgggatgattccaccacttgctactgcgattgccacaactgtttggcccaagaaatttacggaacaggaacgccaagctggtatttctaattgggtattaggtatttcttttatcacggaaggtgcaattccatttgccactgctgatccactgcgtgtgattgtttctagtgtaatcggctcagcaattggaggcggtttgactcagctatggcgggttagtgttcctgcaccgcatggtggtctttgggtattacctttggcttcaaacggattattttatgttttggccgttgttgttggtgcgattgtagctgggatcatattaggaatctggcgaccggttaaagttcaatcaacaaaataaataagtttaaaaaagagtgaggaaaaggcggttagattctgagcacaatctagactaagcggaagaatctgacttttttcactttttagaaataatttatgggaaaatatataaacgaggccagcaaaactatgttttgttgcagcctcgttttttgtaaatattttcagtctgaatattatgaaaaaatgactaaatttaggtacttgaaaatgtataaaattcgtcaaaacggaatttttatacattatggaaacgactgataatcaaagtgtaaaggcctaatgttacaagactatgtaacaatcgccaaatactgtaacatgtttgtaacagtgcttgaaacaggcgttcgctttagaaaagaaacaaaaaaaagtttaagaaagtttaaaggaaaacggataccttaacaactttagtagcaagctttcatatgcttttccaaaagcttattcggaaatatatgcataaacaggctatttttttacgaaatttcgtgctacaatacacttagtaaatttattaggtttatactaattgtttaaaaatgattatttatagctttagaaattgaattaaaggagtggggtatatggttaaatcacacagtaattctaaaacaacaaaggtagtactcgcaggagttgcaggtgcggctggattgtttatcgctggagctacacaaactgttaatgctgattcagtaaaagttgccaaaaatgacacagtttggggcatttctcaaaagtataatgtttccattaagagtattgagactttaaataaaatcaatcaaaagtcacatttaattttggttggtcaaaaagttgaaattcctggaacaacagatcaaaaacaaagcgaagcaagttcaaaagaatacataaaagtcactgttaaagcgggcgatagtttatggcaaattgctcaagataagggtgtctctgttgcttcgattaaagaagctaatggacttagcagtaatttaattttggttggtcaatccttaaaggttcctgtttctggtagcaatgctgctaaaagcactgcaccaaaggttgaatataaggctgcttcttcagctgctcaaagttcatcaacctcagctgcaggtgaaagttcagtttcatcagcgtcagtttccagttcaagcaaggctgaagctgcgtcaacaagttcttcagtttcgagtgtgtcaagttcttcaacagacgcaagttctgtaacttctgaaagctcgagtgtggcttcaagtagcgcggcttcttctgaaacgacctcagcaagtagcactgtatctgcaagtagtgcagtttcatctgcttcaacgcctagtgtggtatctgaaagctcaagtagtgcagcttcaagtacaactccaagttccagtgcagcacagagttctagcgcagctaaatctgtagcttcaacagttagttcgagtgttgcttctagtgcaacacctaaatcaagtgctgcagccgtgaagacagcttattcaacaagttcaactcaaagtagcacagcaacgaaagcttctagtgcagctaagacaacagttacttcagcagcttcatcaagttctaaaacaactgcaagcagtgcttcaaccaaaactacaaccacatcaagcagttctgctttaacttctggttcagtggtaagtcttgctgtcaagttggctaatgccaatattccttacttatggggcggttctactttaagtggaatggattgctctggcttagttgattatgtatataagaatgctgaagggattagcttacctcataatactattgcccttgaaagctatgtcacaacagaatctgtttctgcggctcaaccaggagatttgattttctggggttctaaaggttcaacttaccatgtagctatctacattggtaataaccaatatgttgctgctccccaacctggtcaaaatgttgatgttgaaacaatcagcagttactttgcaccaagctttgcaggacgtgttaaataaattttaaaaaaacaaaaagctggagagtaattgatttccggcttttttgatccaaaaaaatcaggaaacccatctaacattgcaaggtgagtttcctgattttatatattgtaatttaaaacgtcgttaatttgtagttatcactattttgctcatattctaaagctttgccttcaagtggttcaacaaattcaatgttgtaatctgtattatcctcaaccaactgaatagcatcttcttttgttggtgcttccagataaatagatttggaagcttcccgtttaggggttgtttctgcagatgtttggaataaaactttaaaaatcatgacatgtgctccttttaagaaaatttaagatatctaagcttagctgttaaaaagcaagcaacgctaaagattaacatacttattttagcataccaacttctttaagtatagaattggaacgctataaaccattgaaaacgggggatttatgctaaaatggggttaataagtaaaggagctaaactatgatcatactagatattttgattgtgcttatcgtaattggtttgataggtagctatgctattcggcggcgcaaacgcaagcaggctttattagttgtgcaggaggctagtcgcaaggatgtggccttggccatgaagaaagtttcttatgcattggatgaacaaaaaattaccctttctgataaggtcggtactgaacctgaattagtttcggatatctggggacgtggtgtgttagctttcgaattttcatttggaaaaacagatttgaaaaaaagtgaattggagcctttacggcactggattaatgaagtcgtagaaaaatatgcgaaggataatcaaattcctagtaattatgaatatcctgtcttctgcgtgactgatatttggctatatcatgaagagttacacgtggatgtcgcgaatgtcattaatgaacctacaagagagtatattgaagatctgcataaagtggaataaaaaatagagattgggaaaactcccatctctatttttattagccaatgatgacggcatcatcatcaatcttaagcggctcttttttattaatgtgatcatagaaaagggtgcctttcaaatgatcaatttcgtgttgacaaacaattgccggataatccttcaaacgaatcttcttattttcaccatcaacagtttgatatttgagtgtaatacgatcatggcgaggtacgtaaccagggatgtctttatcaaccgataagcaaccttctccttcttcgagagcagcaacttgaacagactcactaacgatcaccgggttaacaagaacatctttaaataaaactggcttatccttaccaccgggaaccaaaacggcggccatttgcaaagaaacgccaacttggggagctgctaagccaacaccagcccgtagtttgtatttttctgcaatctctgggttttgactatttaccaagtattccatcatggtatcagctaatttcttttgatcagctgttaatggaaatgttgctttttctgcgcgttttcgtaatactggatcaccatcacgggtgatgtcattcatttttatcactttcaaaacctccaaatgtttcttcaaaattattttaccatacttacaattaataaaaacgggtaagaacatttttaaaactgtgataaaaggggtagaatgtagctaactgattttatgagaaaggatacagtgatgagtgaaaattacgcgtacccgttagagccagagtgggagatagaagaaattacaactgtggttgctttatacaccgcggtggaaacagcattcttaaatggaattgatcgtcaattgtttttaaatcaatatcgtgatttcaaacaaattgtgaagagtaaatctgaagaaaaacaattaaccaaaaggtttttacaagcttccggatttgatatgtatgtggctgtgaaagctgctcaaacctcaaatagaaagagaattggaccattaagcaaataggtgagttatgaacaatatggaaaatttaagacaaaccgatcaagttattcgcggctggttgaaagaaattcgcaaggatgtgttgggtgaactacatgatcccttgtcagttgcagaaaaaagtagtcgcaaagatcttgtaacaaatgtcgataaagcaaatgaaaaaaagataattaaatatattcgagagcttgatccagaagcaaaaattttgggtgaagaaggacaaggagatcgcgttaccgacatgcaaggacacgtttggatcattgatccgttagatggtactttaaattttgtcaaacaacgcgataattttgcagtgatgatcgctttgtatatagatggcacgggcgtgcttggatacattatggatgtcatgcgtgacattatttatgggggtggtccgcaactgggtgtgtttaaccagagtggccaattacctaaaccagcaaatattagtttaaaagatggtctattgggagtcagcgggccaatgctgattcacgataaatatcatttgcaagcaattgatgaggcaagttccggtgttcgcattattggtagtgcgggaattgaatttattcaggtcttaacgggaaagcaaaacggttacatttctcatttaatgccttgggattttgctgcaggaaagattttagcagaaacccttgatctttcggtgacaaaggttgacggaacacctgttgatatgctatcatcaaatgatgtattagtatcaacaagagatacacacaaagatatactaaatatgattaggtagtctgactgtgacaaactagtcgcagtttttttatggagatacccaggaaaaggagaaacacttttgaaacgacgagatgatattcgaaacatcgcaattattgcccatgttgaccacggtaagacaactttggtgaacgaaatgctaaagcaatcagatacattggacgaacacacccatattgaggatcgggcaatggataccaatgcgatcgaacgtgagcgaggcattacgattctttctaagaatacagccgttcggtatggcgacaaacaaattaatattttggataccccaggacatgcggacttcggtggtgaagttgaacgaattatgcgcatggttgatggtgtcttgttagttgtcgatgcttttgaaggtacaatgccacaaacacgttttgtgcttaagaaggctttggaacaacatttaacaccaattgtagttatcaataaaattgaccgaccaggcgctcgtcctgaagaagttgtcgacgaggtcttagatctgtttattgaacttggtgctgatgaagatcaattagattttccaattgtttacgctagtgcgttaaacggaacatctagttattctagtgatcctgctgagcaaaagcatacaatgaagccattgtttgacacaattatcaaaacaattccagcaccagttgataatagtgaagaacccttacaattccaagttgcactgttagattacaacgactttgttggccgtgtaggaattggtcgcattttccgcggtaaaatcaaagttggcgataacgttactgttatgaaacttgacggttcaactaagaactttcgagttaccaagttgtttggattctttggtttgaaacgcttggaaattaatgaagctaaggctggagatttaattgctgtttctggaatggaagatattttcgttggtgaaacggttacagatcctgcccaccaggaagctttaccattgcttcggattgatgagcctactttgcagatgacattcagaactaatgattcgccatttgccggtcgtgaaggtaagtttgtcacttcacgtcaactggaacaacgtttgaagttggaattgcatactgatgtttcactacgtgttgaagacactgacgatccaggtgcttggattgtttctggtcgtggtgaattgcatttgtcaattttgattgaaactttacgtcgtgaaggttatgaattacaggcttcacgtccagaagttatctacaaggaaattgatggcaagctttgcgaaccatttgaaactgttcaaattgatacccctgacgaatatacaggctcgattatcgatagcttgtcacaacgtaagggtgaaatgcagaacatggaaaccactgacaatggtcaaacacgtttaacattcttggcaccaactcgtggcttgattggttattccactggatttttatcaatgactcgtggttacggaattatgaaccataccttttcaaagtacatgccagttattaaaaactggaaccctggtcgtcgtaacggaaccttggtttcaattaactctggtaaagtgactacttatgcaatcatgggtattgaaggccgaggcacaatttttgttgacccaggtttggaagtttatgaaggaatgattgttggtcaaaacagccgtgaaaatgatatttcagttaatatcactcgtggtaagaaccagactaacgttcgtgctgctggatctgatgatatggctaaaatcaagacaccaactcatttaactcttgaagagtcacttgaattcatcaatgaagatgaatattgtgaaattactcctgaacatgtacgtttgcgtaaacagattttaaatacaaatgaacgtgaaaaagaagccaaacgtcgtaagactgcttcaaaaaaataaataagttataataaaaggaaactcattagttgagtttccttttttgtattttaggaggaatttagaaatgccacaaatctattttttatgtactggtaattcttgtcgtagccaaatggcagaaggtcttgcaaaacaaattttgggaaatgactggcaaattgcaagtgccggaattgaagtacatggattaaatcctcttgctgtgaaagttatggcagagaaacaaattgatatttcaaagcaaacttctaagttaattgatgcagactatttggcaaactgtgattatatagtaaccctatgcggagatgcccgtgatcgttgcccagtaaccccagccactattaagaaacttcattggcctttgcgagatccagcacaagcaattggtaacgaagaagaggttttaaatgtgtttcggcaggtacgcgatgagattgaaaaacgaatcatacaactttctttagattgtgtgtaacagacaaaataaattgtttgcaaaagtatattattactaaattagttgaaccgtaatatttatttcttttaaggtgctaatcatttcttataatgctataatgtaagcgtttagcaggctgcagatagtattatcaaaggggggacgaaatgtcatgaaaaaaagtaactatagtaagctaaattggagcttacaaagggatttagcagaaagaaaagaacattttaaaatgtttaaggcaggacgaacgtggttatttgcgggagttactgtccttttttttggaagtggaattttctttaatcagataagtattcaggctgatactagttctgaatctagttctgtagtggctaaaacttcaacggtaagtaaagatagcactcaaactacaagtaaagcggcatctagctcaagtattgcagagcaaagcaccagtgctgataaggtcaaaactagtgattctgtaaacaatagaaaagaagtacagaatactgttactcagagtgtaagtagttctaataattcggaaagtattggtcagagttctgcagcaatagttgtggcaagtaaagataaaaatttggcaactaacaaattagcaagcagtagttctactgaatcaaccgttgctaatcgagatttaaaaaaagaagattctacgactagtccgacaagtgaagcctcaaaggttgcagtttcttcaacagctacttcaagtttagctaccaatgaaaatgaaagaaacgcgagtttaacaattagttatgtagatgatgacaacgcggaaaacgtaattacaacaaaaaaaataaacggtcaggttggcgataccaatacttataatgtggcaaatgatttatcgtgaactaatattatgtccgaagtcaacagcagtaaaaagaaatatgtattagcaactggtcaaagtggaacggtgaaatatacccttactgcagatgatagtgacaacttattaatccatttgcagttagcaaatcaaacttatcaaatacaatatgttgatcaaaccactggaaaagtgattaattcatccgattctaaactatcagtagatggtaaacctggttcaactattaatactacagctgattatggtttaacacttattctaaaagcaacgaatgcgacaaattatttagctcgacccacagcagatgctccgcagacaataactttatcgccagtttcagacgtgatttcactcccagttgacacaattattaatgcgacaatttaaaccatacctgtttttgtagataatttgggaaatgcattatattttcaaaatttgaatttatcaaatttatcacaggcaaatgtgatagaaattgttactaatatacaagaaggtttctcagaattattgaaaaatgattatttgactactaagaactttaattccgatatgactgattcagtcagtagtcaatatcagtcatttgttgcaaaggaaatgattttatatgacctgccattgctgggcaagctagatacatttttaggaacggcatattataagcacgaatttgataatttaaacgaatatacttattcggacactttaaaaagcctaattgctaatatcttgaatgaatctgtgtctgatgggtcgtttacaattaaaattatggttgaaacttggaacgcaaagcttgagtcattgtatccagagggtatacctgatacaagtgcgatatttaagcaattaccaagtacagtatttgaatcgtcaccagaatctgatagcgatggtccaatagaagcaaagaatattacagatgtctcaaatctaacttttagtacaaatggtgttgtgtcaataaaaaatttaatggtaatccaactgaatttgggcatcattaatgttacaacccactatgtggatgaaaagggagattcattgtccccggatactgaaatcgaaaccgattttcacaccaaaaatcagttaacagcaacaactgtttctgggtatcatgtgcaaaatataaagactactgaatccttaaccaatgttaatacagatattaaaaatggttccgtttcggttgttgcaccaactgatggagaggttacatttgtatatgctaaggatcaagttacgtatacagtgacacaggtagataaaaacggtaagccaattaattgcttaacacctagtgatccaattactgcagacattggttcaaatgtaaacatcccagattatcctggttacacagcgtctcctggacaagatctcgtagttccaaataaagcaaatgggactcagattgatattcaagttgaatacacacctgatacgtttgtcccaaataacggtgatgatgcaaatccaataagtgaggttctagttcatcgaacgatccagtataaaggagctggagttatgacgccagccgatgttgttcaagacgtgatttataagttaatgactgatgagacgactggtgtaacgtcatggacaccgcagaacgtatatagtgccgtagttagcccgaatcttgctggatatcacgttgatcaagttacagtacctatggtgaaacctggagtttttgtgttaaagaagggtgaaacaccaaaaaacgaagcaatagtaacagttaactacagtaaagatacgattgtggaaaataatggggataagactaattcggtgagtgaagtcacggtacatcgaacaattcattacaccggagtgggtgcgaaaactccgactaatatcgtacaagatgtaatttataaagccgttactgataaaacagtaggtaaaaccgtctggacgccacaagggttttacacagctattacaagcccacatgttgcgggatatactgctgataaagaaacagtgttggatgtgattcctaaagccataattatgtctgaagggacacaaccagcagatatcaacgtgactgtaaagtatagtgccgatacgcttgttccaaataatgggaatgaaacgaatccagtaaatgaagttactattcatcgggtcattcattatattggagctgggattagcactcccaaagacgtgatacaaaacgttatttataaggctatgaccaataaaacaacaggtgagacagcttggacacctcaaggtagttatgctgaagttacgagcccaacagttactggatatacagctggtagtaggtacccttctgaaagcgatagttttaactgaaggctccagaccgttagactcaaaagtgaatgtaacttacgttaaagataagacagtcattgttaggccaactgatccaaagaatccaaccgatccagtcgatccaactaatccagatggtcctaagtatccaaaagataacgatgctgtgacaaactttgtggctggctctgatgatgaaacggtgacctatacgaaagatgaaacggtaactgttgatccaactgatccgaaagatccaacgaatcccattgatccaactaatccagatggaccaaaatatccagacggagttagtgagactgatttggataagaccattagtcgaaccatcacttataccggtgcaaacaagaatccggcaagtgttgctcaaacagcaacttatacccggacggcctttgttgacgcgaagacaggcgagctccttggttatagcgattggaccttggtcacaagtgatgatggcaataacaacaatgacggttttgccggcgtcacaagtccaaaggttactggttacacagcagacaagaatgcaccatctgttaccttaaatgatgatgaagttgcaaactttgtggctggttctgatgatgtcttggtaacttatacgccaactaatgagattgtgtacacagaaatgactgttactcggacaattcattatgtaggggctggatcaaagacacctgttgatgtgattgaaaaggtcatttacaaagttggcactaatttgagcactggtgtggtgacatactcaccacagaatgtgtatgccaaggttgagacacctaatattgtcggttatacaaatgatggtgatgttgcagaacttgtccctgttgaaacaacaattgaaccttcaaatagtttggttgtggttcattacaagaaggtttcggattctggtaactcaggcaatggcaatggtggtacgaagcctgagaagcctgaaaatcctggaacgccaagtccgggagagtcagacggtagtggcactggcaattctggtagtaacggaaattctgataatatcgagaatccagaagttggtaaccattctgacaattctgttgataacacggcagcgtttggaaaccatggcaatgcacagttaacagcaaatcaatcaacaaatcagaatgcaaaacgggaaatgactaataaagccagcacgcttccacagactgatgagaagaatgaaaatgttgtagctgtgatgggagttacgattttgagtgcaatgatggcgttatttggaattaaacgcagaaagcacgacgatgagtaagttactcaaaaattaaaaatgggattgaacttcagtgttaggctgaatcgttcaatcccatttttgtgtggacaaaaaggcaagaaaaatcttcacgtaatcgtaacttttaccgtgaatgttagtggtattgcgtaatatatttagaagttctgcgtgttttcctcatttttgccagcggttacgtatgctataatgttcagagttagcacgaaaatatttacaatcaaggtgggttcatctttaatgaagaaatttaagtatttagattattttattgtggtaccatacgtaattttatgcgtatttggaattatcatggtgtactcgtcaagtgctgattattatattattaatggaatccgtgcaacgagctatctttttcgccaaatggcatatgtcatggttggattcttggttgcagcacttgtttttgaacttaaactaaaaaaatttagaagctcaacatttttaaaaatttttgccattgggatgattttctcgtttgtttatctcctgttttggggttcggttgtgaatggtgcaaaagggtggattgaattagggccgattaatattcaacctgcggaagttgctaaattgtttttaacactttatctagcagatatgctttctaaacataatgatcgacttgaaagagatcctaagagttattatcgcgcacctttaattatgacattagtgttcgtcttggctatttttcttcagcgtgatttggggggcgctacaatcaactttacaatcgccctgatcatcttttttgccagtggtattgactatcgaaagggcattggcattattttattaggtgtttcagccttcatgtttgtcttgctaccacttgcatcaagaattaatgtaaacacaaaaaattatatgcttcaacgaattgtaggatttgcgcatccgttcgaacttgccaaaagttcggggaaccaattagttaattcttactatgctctcggaaatgggggtgtgtttggtgttggtttgggaaacagtattcagaaaaaagggtatttaccagaggcaaatactgattttatcatggcagttgtttcggaagaattaggtttagttacggtaagcttaattttaattttgttattagttattgtgggtcgcgcaatttggttaggtattcatgcccataacatgtacgaaactttagtttgctacgggttagcgacttatctttcaatccaaacatttttcaatattggtggtgtaacgggtttactgcctattacaggagtaacttttccgttcatcagttatggtggttcaagtatgttagtgttatcagttgccatgggcatcttgctaaatgtgagtgcaaacgtacaacgtgagcgaactaaaaatttaacactggttcgcgaataaagagtttggaggggtatttgtgaaaaaagtattagtcgcaaatcgtggcgagattgccacacgaatttttcgggcttgcaaggagctttccttacaaacagttgctatttttgctaaagaagacgcactgtcagttcatcgttttaaggcagatgaagcttatttagttggtgctggtaaaaaaccagttgaagcttatttagatattgaagatatcattcgaattgctaaagaaaatagcgtggatgcgatccacccaggctatggtttcttgtccgaaaatgagcagtttgccaaacgttgtgaagaagagggtatcacctttattggaccaaaagtggctcatctacatatgtttggtgacaaactggaagctaaagccgttgccaacaaggctgggattgcaacaattccggggaccaaagatccagtcactagttttgcgcaggtgaaggcctttgcggacaaacatggttatcccatcatgctaaaagcggcaatgggcggtggcggccgtgggatgcgaattgttcaaaaagaatcacaattaaaagaaagctatgatcgtgctaaaagtgaagctatgcaatcatttggtagtgatgaattatacttggaaaaatatttacaatcgcctaaacatattgaagtccagatactagcggattcatttggcaatgttttacatttgtttgagcgggattgttctgtgcagcgacgtaatcaaaaggtggttgaaatcgcccctagtgtaactctgcctattgatttacgaaaacggatttgtgatgctgccgtgcgcttaatgcaatcagtacattatgtgaatgctgctacggttgagttcttggtagaaaaaaaccaattttactttgtggaagttaacccccgagtgcaagttgagcataccgttactgaattaattacggatcgtgatattgtgcaatcacaaattttaattgcacaaggtaaaaatttatttacagatttacattttccacaacaaaaagatttaacttatcaaggagctgcaattcagtgtcgaattacaactgaagatccttcaaaaaactttatgccagacacaggaactattgaaacctatcgttctccaggtggtaatggggtccgtttggatgtcggcaatgcttatacgggagctgttatcacaccattttttgattctttgttggtaaaagtttgcgtgcatgacagtaattttaaaaatactgccaagaaaatgttacgagtattaaacgaatttatgattagcggtattcacactaatataggctttttgaagaatgtaattagtcatccggtatttcaatcaggagaggccacaacgacctttattgacgaaacgccagagctttttacagttcaaaatgatgctaacccgaccaataaattattaacttacatgagtaagatcacagttaatggtactgatggggtaccaagtcacgagaaaaaatattacccagaagccttagaaaagttacaaattattcctcaaaaagagcaaactgcaaaagatatattagtgactcaaggtgtgtctggattacaagaatggattagcaatcaatcacaattattgttgacagataccactttgcgagacgcccatcaaagtttatttgcaacccgaatgcgtacccatgatatgttgccaattgcaggtaaaatcgatcaaggattgccacaattgttttccgccgaagcatggggcggtgcaacgtttgacgtggcgtaccgtttcttacacgaagatccttgggtacggttaagtgagctacgcaaaaagatgccacatacgttactacaaatgctttttcgtgggagcaatgctgttgggtatcaaaattatcccgacaatgttattcaggaatttatcagattagcagctaaaaatggcatcgatgtttttcgaatttttgacagtttgaactgggtgccacaattagaaaccagtattcaagcagttcgtgataccggtaaaattgccgaagcaacaatgtgctatacaggtgatattttggatgcaggtcaaaagacttacacgcttgagtattacaagaatctagctaaagagcttgaacaagctggtgcccaaatcttggcgattaaggatatggctggtgttttgaaaccggcagcggcttatcgactgattaatgtacttaaagataatatttcaattccgattcatttgcatacccatgatacaacgggcaatggtattgcaacttatttgagtgctgcaaaggctggtgtggatattgtggatgttgctgccagcagtatgtccgggactaccagtcaacccagtttaagcactttgtactatgcaatgacgggtgacaaccggcaacccacaattaatattcaaaatgcagaagaaattaaccgttattggaaaggtgttcggccgttctatcaagattttgagaatggcatgaccggttcccaaactgatatttaccaaacgcaaatgccagggggacagtattctaatttgcaacaacaagcccaagcacttggcttaaaaggccgttttgaggacgtgaaacaggcttatcgccaggttaacacgttattcggtgatattatcaaagttacccccagctcaaaagtcgttggggatatggctttgtttatgattgaaaatgatttaagccctgaagaaatcctttctgaaggtgagcaccttgactttcccaagtccgttgttgacttttttgctggaaatttgggacagccggttaatggttttccaaaacaacttcaaaaattggttttaaaaaataaaacggctactacggttcgtcctggtagtttagccaaagcagtcgattttgccgtagttgaaaaaaagttgattaaacagttacaacgagatgttacccccgaagaagtcatcagtgctgtcttgtatccaaaagtatttgatgattataatacatttatcgattcggccgggccggtgaccaaattagatacgccaaccttctttcagggtatccgtcgaggagaaaccgtggatgttgaagtgcggcatgggtaccatctgattattaagttaaatcaaattggccaagttgatgagcaagggcaacgaactctttactacgaagttaatggtcgtaaacaagatattgtggtgcgtgatctaagtattcacgaaactgcaacaactaagcgtaaggctgaacccacaaatagtaatgaaattggggcaacaatgagtggttctgtgttgagtgtgaatgttcacgcgggtgataaaattggcaagggcacaaacctgttggttacggaagctatgaagatggaaacaacaattcaagctccgtttgattgtgtcattaaacatgtttatgtagctgctggtgatgttgtggacacgaatgacttattgattgagattgcacctcaaaagcttaaataggcttgtgagacgcacataggaggcaattatggaatttacacttcaatctcgacaaagtatcattattaatttatctaatttaagacaagttaagcaattgaaaaagtttggcattttgtattacgtttcaaaaagcatgaaatatgctgttttgtatactgatcgtgaactggcccaaaaagcttgtgttgcaattggcaaattatcaagcgttaaaagcgctgaaatttccccgcgtgcagacttgaagatgaactttgatgatgacgaaacggcggaatttaaacgtacaaatgaagactaggtgaatgataaatgcgagtggtttctggagattttggtggtcgtcggttaaaggcagttcctggtgtaaaaacgcgaccaaccacagataaagtaaaagaatcgatgtttaatatgattggcccttattttgatggtggtcggtccttggacttgtttgctggaagtggcggattgagtattgaggccgtttcgcgagggattgataaggctgttttagtagataagcaacggcaagccattcaaacgattgaacaaaatgtggcggttactaaggcacaagatcaatttgaaattatgcgtcaagatgccaatcgagcactaacaattctggctgatcaagacataaaatttgatctgatctttttggatccaccgtataaactccagaagattgtcaaagaaatggcaaaaatggttagtttaggattattaaatgccggtgcaattgtggtctgcgaaacggatcaatttgcaaaattaccggaatctatgcccaactttaagctttggaaacgacaagattatggcatcacggaagtcagcatttatcaatttgaaacaggtgattagatgaaagttgcaatttttccggggagtttcgacccattgactaatgggcaccttaatataattaaacgggcaagtttgttatttgacgaactggtagtggctgtcgcaattaacaccagtaaatcagcattatttagtactgaagaaaaagtacggcttattcgaaatgctgttagtgatttgcccaacgtacgagtgatcccgactaaggggcttaccattgacttgtttaaacaattagaggcaaccacgttagtccgagggttgcgggatgaggctgattatcgctatgagcgtcaaattgcagagatgaatcatcaactcgatcacgcagttgaaacaatctttttaatggcgaatcctcggaatacttatgttgcttcaagtattattaaagaaattgccaaaatgggcggcgacgtatccagttttgtgcctgcaaatgtcgtgcaacctttaaaagataaatttaagtaaaggagatacattttggcacgaatccgaaagtttttcaaaaaatattggttattactagttgcaatgatcgttgcgcttgttttcgtgtttttacctttaccattttatgtagaaggtcccggaacggcggatcaattgagtcagtacgttaaagtgaatcataaacgcgatcacaaaaagggaagtttccggatgaccacagtttcggtgatcaaagggacgccagcgatgtatgtgtttgcgaaaatcatgcccaattatgaagtcgaatctgttagtgatattactggtaatcaagataatgccacgtataataaagtacagacattttatatgaatagtgcaattaatcaagccatttatgtggcctatcataaggctgataaggctgtgaaggttcatttcaagggcatctatatccttgagattgagaaaaattcacaatttaaacacgttttacatgttggtgacaccatcaccaaagtcaataatcagcgattagttagtgccgaagatgccatgaagaagattagatcacataacgtaggcaattccatcacaattacttatcagcataatggtaaaactaagacagcttctggtaagctagtccgtttatccactggtaaacctggtattggtattggattaacagacaataattctgtgacaactaagattcccgtttccattgatgcgcatgggacagaggggccgtctgcaggattaatgtttacattacaaatttatagtcagttaactaatcagaatctgcgtaagggtcgtaatattgccggaactggcacaattgctacggatgggtcagtcggtgaaattggtgggattgacaaaaaaattgttgctgccaaaaaagcgggtgccacaattttctttgcgccttatctcaaaccaacgaaacttgttgagaaatatgagccaaatcatttgactaattatcagttggcaataaaaacggctaaacgaattgatccgaagctgaaagtggttccggtaaagaattttgaggatgccataaagtatttgcaaaaaaccaaatagttttatagaacaccaagagatatttttaaaaagttatcgaaaattgataataattaaaaatatctctttttatgtgcgtatttaataggtgaagggatgtgaggagtgtgattgaagaattatgggaaaactataaaaaatacattttaataggtggtgggagtgttttggtagtgttagttgtctttcttttgatgggaaaacacaactcaaatacaaactcagatgcattaacgatgaatagtggtgaaaattcgtctgaacaatttagttctagtaatcaaacgagttcacctgccaccgtttctggaacggcaagtggtcctacaatgactactagtgaaactacaagtgaatatgtttatgtggatgttaaaggcgcagttaaacatccaggaatttttaaagttaaaaattcgatgcgtgtggacgatgcgattaatttggctggtggaatgctcaaaacggcggaccgtaaacatattaatttggcacagcgattaacggatcaacaagttgtttatgtgcccattcgtggtgaaattaaaggtgctgcaacgggtaccgtggatgcagaagtagccgcaccagtttcgtccgattctactacaaccagtgcatctaatgacagtagctcttcaagtgagacgacaggtggaagtgaatctacaggtggaacagttaatttgaattctgccacaaaagaacaattacaaacgctgaccagcattggagataaaaaggcagatcaaattattcagtatcgagaagcgcacggtaaattcaaaagtattgatgaattaaaggaagtccaaggaattggtgataaaacatttgaagccctaaagccacaattaagtgtgtaacctagcggtaaatatttggtatactttaacttaaagaaggaaggcatttttatgagtgataaaagaatcccatgggatcagtattttatgacacaagctgttttactatcgctgcgaagcacctgtacacggctctcagtaggtgccaccatcgttcgtgacaagcgcattattgccggcggatataatggttcggtttccggtgatgtacattgtattgacgagggatgttatctagttgatgggcactgtgttagaacgatccacgccgaaatgaatgcaattttacaatgtgcgaagtttggtgctgcaactgatggtgccgaaatttatgtgactgactttccatgtttgcaatgtaccaaaatgattttacaggcaggcattaaaaaaattcattatttacgaaattatcacaatgattcatacgcaatggggcttttaaaacgtatgaatattgaggtgcagcacgttgaatttactgatgaagaaattgcagctgtttcaatggataaaattttaaatcaagactagctttgaagcttttccatggttttttattgcaattttaagcgttcttctcgatgctgtaatcacatctcacgtttgggtattaactctgttagttgtttattggatgattcgggtctgctttttacgcgacaaaacgatgatctattggacgttttttgctgggtttatttttgccatgttgttttggtggcatagtacgactttgaatcagcaaacgatggctagtcagcccaattggcagggaagtctgatagttcagcctgatgaactaaaatgccagggagattattttcagtttactggtgtggacgagaaagggcatcgactgagagtttccgggtatctaaaagcagcgcatgaaaagcaacaattagaaaaaattcggcgaccagtaaaaatactagttcgcgggcaaattcaaaccattgatcaaccaggaaatttgaatcaatttaattatcgaacttattgtttttcaaagggaattactaatctattaagtaaaacaaccgtagtgagttggcaaccaattcaggcaagtaatccaattgtaggaatttttgggcttttgcatacttggcgaaataatatgcgactttattgtcagcaattgcctaaactaatgcaaacatatgcgctaagtttgctgattggtttcaaagatgaggcgtttgatgaagatatggagggtgtcacaactctgggtttgcttcatctttttagtctatcaggattacatgttttttatttttgttggttattgcgccagttattcctgagattacgtgtaactaaggaaacgacaagtatcttgctgatttgctttctacctgcctttttgattattggtggtggctcggggagtctttttcggtcaattatgatggcagaattaggcatgttaggcacgactttaaaaagacgccacacacaattgaatgtgtggagtataacaatgctggtgaatctagtctttgatccgtatgttattttgagtatgggtggtcagttgagttacttactgtcatttttacttatttttgttggcagttattcgtcgtttagacgggcctgggttctaaatattgtgagtttaccaattattttgtttcatacctatcagtggcatctgttaacttcatttgcgaactttttgattattccaattttttcaaattttgtgatgccattggtgatcatgagtgcagcaacgttttggttaattccacaactgagtagctggttcacggtgggcttgcagttattccatcaattggtaaccttgttgagtaagttgcctggacaaattatttttggaaaacctcctttagcatttacggccgttttagtaatcatttctctcgcctggattgcatttcccagatacaagagacgaattagttggcttttgttaagctgttatttaatgggattcatatggattcatttcccgcttcatggtgaggtaacttttgtggatgtgggacagggggatagcatcctaattagaatgccattcaatcggtccgtgacagtaattgatactggaggtaaagttggtttcttgaaaccggcatgggcaaaaggtccagagaaaaagcataccccaccagttctagattatttacatagtttaggaatttcaaaagtaaacacgctatgtttgtctcatcaggatgcagatcatattggggatgccggagtgctgttggctggcattaaagttaaacaagtggtaattcctaaagggatggaaaattctcgtggttttcagtccaaagttaaaccttttctgcaaaaatcagcgctcttaccagtattggcagatcaaaaggtagccaatttgccatttgaaatcgtgcatccgtttgtagaaggtaaaggtgaaaatcatgactctttgactttatgggccaagtttggcgatgataattttattttttcgggagatttagatcaagcaggagaacgagatattattgcccgttatccgcaattacaggcttcggttgttaaactggggcatcatggaagcaaaacagcatctgctaaagattacttgagccaaattcgtgctaaaattggagttatctcagctggaaagaataatcattatggtcatccaaatccagaaactcttcaaactttgaaacagttaaagattcaatcggtatcaacgattgatgagggaatgatcagttatcgcttcacctctcatggatttacaaattggcgttttgtacggaggaattatgaaaaagatacagtacactgacttacttaaaaaactgaatgcagatcaaaccgatccggtttatttaattttgggtcaagaggattatttggaacaacaaattcaacgggcttttcagaatttagttccaaaagaagagcaggaaatgaatattggcaattatgatatggaatcgacttccttgggagcagccttagatgatgccacatcggcccctttttttggtgaacggcgtgttgtttttgtgagggatccttattttttaactggagaacgacataaagggggaccaaaccatgatgttgatggtttgcaaacttatttggaacatccggttgattccacagtgttagtaatatttgccgcttatgaaaagttggacgggcgcaagaagattgttaaaactctgaatgaacaagcgataaccatccaaattggtaatttaaatcaaggtcaaattagtcaattggttaaaacacgccttactacaaaaaattacactatttcaccagaggctttgaatcagttgttatttcgcacagactcaaaactgagtaccatgatgaatgagttaccaaaattaatgctttataatattggaaaaaaagagattacggtggaatctgtagatgctttggtttcgaaaagtcttgatcaaaatgtttttgatttgagtaatgcagtcttgcaaaaaaagtctaaacaagctatcgatatttatcaaagtttaattacgcagcaagaacagcctttgcgaattaacgccgttttagttgggcagatcagattattgttacaagtgaaaattttacaaaatcagggtttttcacaaggtgatattgcgggaaccttaaaggttcatccttatcgagtaaagttggcaatgcaaagtagtcggcatttttcgatgaccgatcttacaaagggatatacaggattgattgatttagatttacagctaaaatcaactcaaaaagatcctgaacttctgtttgaactgtttttgctacaatttattgatcaaaagattgcttaaaagtttcgataataaaagccctgagacagatgcctcagggcttttattcgtttcataaattatttagcaagttgttttgttaaacgtgactttgtacgagcagccttgttagctttgattaagccctttgttttagcttggtcaagtttactgatagctgtaagatataagtcttgtttgtcgtcagagcccttaacagctgctgattcgaattttttaactgcagtccgtagcttacttacttgtgattggttacgtaaagctgctttttcgttagtttttactcgcttcattgcggatttaataactggcatttgattcacctccactgatctgaaatcaatactacaacaagtgttattatacagaagacaagtattgaatgcaataagaaattgtcaagtaacattacttgataggcaaaaacacttagattatccatgacgagggaaactaaacttgtgttttatgtgaaagttaggtatgatatatcttgtgtgttaagcacgaacccatacttggtttatcgaatcaccaacgattaacccagtttcgggcaataaataaaaggggtgaaaataatggcaatttcacaagcaaagaaaaacgaaatcatcactaaatatgcgcgtcatgatggcgatactggttctacagaagttcaggtcgctgttttaactgcagatattaatgaaattaataagcatttaagcgttcataaaaaagatttccattcacaacgtggattaatgaagaaaattggtcatcgtcgtaatttattagcatacttacgtcgtactgacatccaacgttaccgtgatttaattgaatcattaggtttacgtcgttaagattttcaaaagcgaagacttcggtctccgctttttttgtgctctcgattaaataacggtcttaaaaataggtttagttcacttttaaagaaaacttataaactttcaaatacttggaacacaactctcgtattaaaatgtggtaaacttaaagcagtttatacgtcgagacagaatagattttgtaataacgcattaaaatgtgctgtagtagggttaaaagaatttttggattaaataattctaaatatggactatttagaattgtggaccagaaaattcaaccgaagttttatatttgagagcttctaagtggcgaacattgatctagtgtcgttttaaagctcacatatatttgatagataaacaagcagaaaatgaaagtaactaaaaatttttgaggtggaatgaatgagtaatagtatcaaaattatcccatttagtggggtacgtgaaaacggcaaaaatatgtatgccgttgaggtgaatgattcaatttatattttagactgtggattgaaatatccggaaaatgaattactgggaattgatgtggtcattcctgatttttcttatctagaaaagcatagtgacaaaattgtaggggtgttcttaacacatgggcatgcagatgctattggggctttaccatactttttggatcaatttccagttccagtatttggttcagaaatgaccattgcattagccaaactcaatgttgaaaaagacgccaaattaaaacagtttactgattttcatattgtgaatgaaaaaatggaaattgattttggggatgtgacagtttcgttcttcagaacaacacattctattccggaatcattgggaattgttttaaaaactagtgaagggcaaattgtttatactggtgatttcaagtttgaccaaactgcatcaagtgactatgcaactgattttggacgtttgggccagattggtgagaatggtgtattagcgcttcttagtgaatctgcaaatgacgaaaatcctaaaccatcaaccaatgaacgtgatattgctaactatatcttggaaacgttcaagtatcatgaaggccgaattgtagttgcttccgtggcatctaatatcttacgaattcaacaagttctggatgcggccgcccaatctgatcggaaagtggtccttacaggtcatgatttagaaaaaattgtcaatactgctttacggttgaataaattacatttacctgcagatgatgtgattgtgccatttaacaaattagagagtttagacaaagaacgtactgttgttttggaaactggcaaaatgggagaacctattaaagctttacaaaagatggctagcgatcctggtaaaggaattcatatagatcctggtgatttagtctttattactacgaccccgtcacacgcaatggaaactaccgttgctaaaacaaagaacatgatttatcgtgccggtggtgaagttaaagctatttctgatgatttgaatgcttcaggtcatgccagcaaaaatgatttacaactaatgattaatcttttgaagccaaattacttgattccaattcaaggtgaatatcgtttgttaaatacacatgcgcaacttgctcgtgaggtaggcatggcagatgatcacatcttcttaacccaaaagggcgatgttttggagtacaaaaatggcgagatgcatttaggccagggcattgaagttggtgataccatgattgatggaatcggtgttggtgatattggaaacattgtgttgcgggaccgaaaaattttgtcggatgacgggatttttattgctgttgtgacgattgaccgcaaaaaaaagttgattattgggcagcctaaagtaacctcacgagggtttgtttatgtcaatggagagcacgatctacttaaggaaagtgcttcgattgtgacagaagtggttcaaaacaatcttgataacaaggaatttgattggggccatttgaaacaggatattcgggagaaaattagtcgatatctgtttgatcaaacaaaacgtcatccagtaattcttccagtaattatggaagttaatcaacatcatcataaagcaccaagtaaggcatcaaaaaaagttgaagaaaagtaaattagaaactggtaatgttgagttgattgacattaccagtttttcagtggaggtttatcatgcaagatgaccaattattaaaaatcaagcgggctgttgcggatgaacagtggaataaagtgcttaacctaattgaacctattatttctgaaacagcaaataatcagcaactacactatttattcgttttgagtttgtttaaaactaaacactatttggaaggcctaaaatatgccaatgattactacgacttttatgccaatgattcaaaaggccaaaacctttatttttcgcttctgttagcttgccaggactttttaggtgcccatcaatttttggaaattttaaaacaagatcatgttgacaatatttccgattatgtgacgagtttgactaataaagaaatcgaagttcgccagcaaaaagtgactttaaatcaaaaattaaagaagttttaccatttgggtgatttatcagtgagggaagccaattcaacattgcaagaagcaaagcaattacccgcaactgaatattttcaagcggcgcagtttatttttgtggatcctttcgtccatcctttgattcgagccacggtccttgaaaatgttgtttcgttaaaattgaagggaaaaattaagtattattggttagaccaacaaaatcatgaaatcgatttaacccgattaactgggattttggataacccggttcaaataaaattaaataaatttttacaagaaaaattagctgacagtgatccaattttactcgaaggaatttcgaaagataaaaatctctatctaagttatgtttatccttatgcaaaacaagtttttaaaaagcctgaagagtgggtgaactattggctagatgactactatggtcgaatgcatccggatacagaagatacgcgttttatgactaaatggcagggaaagtttcggaaatatacgactgaacttttggaaaataacgatataaataagtaaaaagctataaatattgcaatttttttggcttaattggtttacaaacttcagtgttctttatataatgtttaaggattctcttaggcgagacctttgccttttcatgaggatgtagtataatagtttttaaagaatccagccacgccaagggctgagtaattcttacgaaaaatacaggaggttcgtattaatggcaaaagaacattacgaaagaacaaaaccccatgtaaatattggtacaattggccatattgatcatggaaaaactactttaacagcagcaattacaaaggttttagctagcaaaggtttagctaaagctgaagattatgctgatattgatgctgctccagaggaacgtgaacgtggtattacaatcaatactgcccatgttgaatacgagacagagaaacgtcattatgctcatattgatgctccaggacatgctgattacatcaagaacatgatcactggtgctgctcaaatggatggtgccatcttagttgttgctgcaactgatggtcctatgccacaaacacgtgaacatatcttacttgctcatcaagttggtgttgactatatcgttgtcttcttaaacaagactgatttagttgatgatgacgaattggttgacttagttgagatggaagttcgtgagttgttatcagaatacgattatcctggtgacgatgttcctgtaatccgtggttcagctttgaaggcacttgaaggcgacccagaacaagaaaaagttattcttcacttaatggatgttatcgatgaatatatcccaacaccacaacgtgacaatgacaagcctttcttgatgcctgttgaagatgtcttcactatcactggtcgtggtactgttgcttctggtcgtattgatcgtggtgaagttaaaatcggtgatgaagttgaaattgttggtttgaaagacgaaccattgaagtcaactgttactggtcttgaaatgttccgtaagactcttgatttaggagaagctggcgataacgttggtgtattgctccgtggtattaaccgtgaccaagttgtccgtggacaagttcttgctgcacctggttcaatccagactcacaagaaattcaagtcagaagtatatatcttgacgaaagaggaaggtggtcgtcatacaccattcttctcaaactatcgtcctcaattctacttccatacaactgatgttactggtgtcattgaattaccagataacgttgaaatggtaatgcctggtgataacgttacatttactgtagaacttatcgaaccagttgccattgaaaaaggtactaagttcactgttcgtgaaggtggccatactgttggtgccggtgttgtttctgaaattgatgactaattagtttacggcattttatttaattttgttgccatgaacattttcatatcaagcaacaagataagtttttgtagtttcgacctttagttgaggatataaaaaagccgtaaaattagaattgaatctaattttacggctttaattgtttaacgaattacatcatgccgcccatgccacctggttgtggttgtgcaccggctgctgcatcatctttgggttctggtttgtcagcgacaacggcttcagttgttaacaacaaagctgaaacactggctgcattttgtaaagcagaacgagtaaccttagttgggtcaacgattccggctttaaccatgtcatcccagttaccagtagctgcattataaccaatacctggcttctgcttcttcaagttttcaacaacgacagagccttctgcaccagcattctcagcgatttgacgaactggttcttccaaagcacgtttaacaatgttgatacctgttaactcgtcaccatcagctttaaggccatcaagagatgaaatagcattaactaatgctgtaccaccaccaggaacaaaaccttcttcaacagctgctcgagtagcattcaaagcatcttcaattcgatacttcttttctttaagttcagtttcagtagctgcaccgacacggacaacagccacaccgcctgctaatttagctaagcgttcttgtaacttctccttatcaaaatcagatgtagtttctgaaatttgttgtttgattgtcgcaactcgttctgcaatctgatccttgtcaccagcaccttcaacgattgttgtgtcgtcttttgtgacagtaaccttgtttgcttggcctaattgatcaatggttgcatcttttaagttcaaacctagatcatcagtgattacagtaccaccagtcaaggttgcgatatcttcaagttgagccttacgacgatcgccaaaacctggtgccttaacagcaacaacattaaaggttccacgcatcttattcaataccaatgttggtaaagcttcacctgtaatatcatcagcaatgattaaaagtgaacgactttgttcaacaacagattgtaacaatggtaagatatcttgaatattgctaatcttcttatccgtaattaaaatgtaaggattgtctaaatcagcttccattttatcgttgtcagttaccatgtattgagacatgtatccacgatcgaattgcattccctcaaccacatcaagggttgtatcaaccccacgtgattcttcaacagtgatgacaccatcgtttccaaccttttccatagcgtcagcaattaacttaccaacttcttcgttagcagctgaaattgaagcaacctgggcaatatcgtccttagttttaacatcatgtgacatcttgtgaaggccttcaacggcagcctttgttgcacgttcaattccgcgacggataccaactgggttggcaccagcagtcacgttcttcataccttcattcacaattgcctgggtcaaaacagtagctgttgtggtaccatcaccagcaatatcgttagtttttgaagcaacctccgatactaacttagcacccatgttttcaaaatgatcttcaaggtcaatcgccttagcaatcgtcacaccatcatttgtaattgttggtgaaccatacgattgctccaaaacaacgttgcgtccttttggtccaattgttgatttaacagtgtcagctaatttgtcgacaccctttaacatctttgtccgtgcatcttcagaaaattttatttcttttgccataaatatttcacctcaagaattctaattttagttagtcaataattgccacaatatctttttcatgaagtaccaagtactttttatcttcatatgagacttcagtaccggcatatttatcaaatataactgtgtcaccggttttaacagaaggtgcaaccttttcaccgttatctaatacgcgtccatcacccacagcaacaaccttgccgctttgtgacttttccttagcattgcttgcaaggacgatgccaccaacagtttgttcttcttcttcctgtgcttctaatatcacgcgatctcctaatggttttaacaaaatgaatccctccagttatttattttataaatttagcactcttaactgctaagtgctaacaacaatatttactatatcattctcaaactagaatgcaagcattttactgaccttttttgacgaaagaattcaaaagcctttaaacatgctatactatagtaatatttgtgaggtgtcgtcagttgaaacttgaaaagaaatctatctatatcttaattacgtatttaattgtgtatcttttgccaagcttcctaaatagcttttttaaattcacacacagcatgatctttagcgtccaaattatcgattatttagctggtgcactaattttaggctttttggcatttcataatatgccccaaaaccttcccgaaaaaaaatcgagtcatacctggcagattattctgtggggcattctcggttttattattgtcatatttttacagagccttatcctcaaagtaaccgttcaaactggtggaagtgcagcttctcaaaatacgagtgccattttaaaaatcatcaaaaattatcccttatttgtcttgcccattattattggcgctcccattatggaagaaattgtttttcgaaaaactctttttggaaatctctcaaatctctttggctttttaggccctaaagtctcacagatactaactgccttgatttctagtggcttatttgcaatcgctcattcggacggtcatattgtgctctatgccactattggactatggttttgttggctgtaccatcataccggcaaaattcaaacctcgatgattgctcacattctaatgaactctttagttgtcctcccttttctagggctttgatcatttaaccatgattaatggcataaattaaagtttgtaattcattggtaagatcaatattttgaatacgaacgccttctggcacagaaatccgcacagtggtgaaattcatgattcctttaatgccaccctggactaactcgtccactactttttgggcaattgtggctggaaccgtaataatggcgatttcaatccgttgatccttcagctgttcttgtaattgtctcatgtcataaacaggcacattactttgcacggagccaatcaatttaggattaacgtcaaacgccgcactgatcctgacattgctatttttatgaaaattaaaatttaacaaggcatggcctaaattaccaaccccaatgagggcaacgtttgtaagcgtgtcttgatccaatatctttttaaagaaatcaattaatttgtaaacgtcatacccatatccgcgcttccctaatggcccgaaataggagaaatcgcggcgaattgtggccgcatcgacttgaattgattcggctaactcagcagaagaaactcgcaacttgtttgcatacaataaattatttaaatatcgataataaagtggcaaccgtttagcagttgcttttggaatttttgtttccattttgtaaacctccaatgaagtttgtgaataattaacaaactttattttaccacttactacagaaaacaaaatttaagatataataaaagagcaacacgaaaggatgaatgattgtgatcttattacaagcccaagatgttagccgtgagtttagcggtgagcccttgttttctcatgtaacttttgacattcaagaacaggatcgaatcggtttggttggacgtaacggcgccggcaaaaccaccctgcttaagatgctaattggcgacactcgtccaaattctggtgaaatcacaaccaaaaaggacctttcaataggctatctggctcaaaatcaaggcctgaatactgataatttaatttgggatgaaatgctgactgtttttaaggctgttattcaactcgaaaaagaaattcatgaactagaaaatcaacttggtgatcccactgtcattgcaaacgcaaaagaattcgaaaaattatctaatttgtatgatcaaaaacagcaagagttcaaagctcgtaatggatttggctaccaggctgaaattcgtggcgtcttacacggctttggatttgaagaagccgtttaccaacggtcagtaaacaccctttctggcggtcaaaaaacaaaactggccttagccaaactgttgttggaacaacatgacttactagttttagatgaaccaacaaaccatcttgacatgaatacgttggcttggttggaaaaatatatcaaatcatatagtggcgctttactcatagtttctcatgaccggtactttttagaccacgttgtgacacgaactcttgatatggatcgaaagacattaactgcatacactggtaactactcagcctatgtcgatcaaaaggctgcccgtttgaaaacggaatggaaagcgtacgaaaaacaacaaactaaaattgataagttagaggatttcgttaacaagaatttagtgcgtgcatctacaacgaaacgggcgcaaagccgtcgtaaacaattggaaaaaatgactgttttagatcgtcctaccgataacaacgcagaaatgcattttcattttgcagctaaccatgccagtggtaatgtggtattaaccgttcaaaaggccgccattggttacgatgatcacgttttgtctgcgccaattaatatcgagcttaataaacatcacgtcttaggaattgtgggtccaaatggaattggtaaatcaacgttattgaaaactattctgggtaaaattcctttgcttgatggcacggtcagacttggtgctggcgttgaaattggctattatgatcaggaacaacataaccttgatgataaaaaaacggttttgaatgaattatgggatcagcatcccctagttcccgaaaaggacattcgctcacttcttggtagtttcttattttctggtgatgatgtcttaaagccggtgaaaaaccttagtggcggcgagcgagctcgcttattactcactaaactgaccatgcaagctgacaattttcttattttggatgaaccgacgaatcatttagacattgatagccgcgaggtgcttgaaaatgctcttaatgactttgatggtactgtcttgtttgtttctcatgatcggtatttcattaaccgggttgcaaccgaaatacttgaaatttcacctcatggaagtcaattgttcttaggtgattacgattattatttaatgaaaaaagcagaccaagaaactaattctgtagacgcaactgatgggactgatgacgttttcaattctaatgaaagtacgaagcaacaagactaccgtgcttccaaagaaaatcagaagattcagcgaaaattgcaacgagaagttgataaacaagaaaaacaattagatgaactttctgaagctgaaacgcaaattcaaaccaaaatggccgatccccaattttttaacgatcatttaaaacttgaagaattacaaaacaaattaaccgaaacacaggataaaattacacaggttgaaaataaatggacccaacttagtgaacaactcgaaaaattgaattaaaaaaggccaaatttcaaaatcacgtgatgtgtgactacgaaatttggtcttttttagtttaataactagtcttcgaaaaataagtcaattaagcgatcccgatcttcactccatcggctgttttcccgagttgggtaaatacggttagttaaaaatacaaacccacgtttaatttcaggatcaaacgataaaatggtgccagtatagccagtctgaacatactgttccttatggttaacacgtcgccaacccaaagtgcgcccattttcatcatagcttgccattaaatcaaacaagttaggatccaaaatttcttttttctgatattttccccgattaatcatcatttcagtaaaaacagttaaatcgctcaaggtagaaaagagtccagaatgaccactttctccatttagtaacagtgccttgtaatcatgtacctggccttgaatttggcctcgttgggcatccacttcggtcggcacaaaccgagacttcggtcggttcaaattgtagccagtattagtcattgccaacgggtaccaaatatgatcctgcacacttttatcaatcgaaccatttaaagtgcgaataattaaacccaacagaataaaacctaaatctgaataaaccgtcttttctcccggttgatacaccagtggatcctcgtacaactttttgatgagttccacacccgtcaaattgcgttcattttctacatcggctggcaaaccactattgtgcaacaatagattttcaatggtcacctctggatgtgaaaagccaggcaaataagccgtaacagaatctttcaggcctaattcatgaattgccaataactgaaaaacacgggtagttgttgccactactttggttaatgaagataaatcataaatcatagaaggatctaaacgttccgcaaacgcatctttaccttgaaaaccatggtaaaaactatcgatctgattttcattaataaaactaaacgaagcgccataaatatcaccacgatcaataaacatgtcgatttcgtctttcattttagtaaatttgttatctgtcatctacttgtctccacttcgttttatttgacggcatctgggacccagtcaaattctaaacttggttctgcatttaaacttgcgtccgcaaaaacatgatgtttcatagctacataaccagccgcaccaatcattgcagcgttatccccacataatttgagaggcgctttaacaaaatccaagtccggatattgctcacttaatttttctgacaaggtatcacgcaaaccatgatttgcggcaacccctccggctaaaatcagctgtttaatggaaaactgttcgcatgcccataatgttttctccacaatgacatcgatgacactttgttgaaaactagccgctaagtcagcccgatccaaagtttcattaatttggtctgcatgatgcacagtattaataaaagcactctttagaccactgaaactaaaatcaaagttttcttcgtgcatcatagcgcgaggaaaatgaaaactatctttacccttgtgtgctaattcatcaatgtccttgcccgctggataagttattcctaacacacggccaattttatcataagcttcgccagccgcatcatcacgagtttcgccaataatttgaaattcattttcataaggcatatatactaattccgtatgcccgcctgaaaccaataaagctatcgcaggaaactcaatgggcttaacaaatcgagccgcatagatatgacctgccatatgattcactggaatcaatggcaagttattcgcataggcaaacgctttggcggccgcaacgccaactaacaatgctcccaccaatcctggaccatatgtgaccgcaactgccgttaaatcggttgttttcacatttgcttctttcaatgcttcatcaatacaaattgtgacctgttcaatatgatgacgactagccacttctggcacaacgccgccaaatcgtttgtgactattgatctgcgttgctaccacatttgacaaaatcttttcaccattttcaatgactgccacactggtttcatcacagctggattcaaatgccaaaatcaagtttttcttatccataattctcctactctttttgtgtcagtgccaatgtcatatcaatggcatcttcatgatcgccaaagtaataatgggccttgacaccggttttctcaaaccctaattttaaatacaacgcctgggcgcgcgcattacttttgcggacttcgagagtgagctttttataaccaataaattctgccttaccaatcattattttgagtaaataagacccaattccccggttctgtttatcttcaaccacagccacatttgtaatatgggccgtctttgttcgatcgtcaaaagaggcaccgataaagccaagcatgcgatcgtgataccgaatcaccaaataaagtcgatcaaacttacggcgtagttcattcgcaaaggccgcgcgatcccaaggagtctgtccttcatagacagaacgttccacattcaaaatatctggaatatctgggatcatggctttggcaataaaataagtgtcatcttcaatttgaatgacatgatcatgaatttcaaatgcttgttctcgtaattgtttagtacgattaaaaaaacgattttgaataagttctctaaattttttcaacatacggcttcgtatcctcgtgtggatgttttttcttccattcaacttctgcttccgtcaaacgtaaatatttgggcacaaaattaaagggatgctcaaccggtttctcgtttaagccgagttgtcctaatacatatgcatctggcaaatcttgtgcacgcgataccctgtgaaaattatcagtcaattgtaattttagggtttcttcataaatggaaacgtcttgcccaataaaccacacagggacttgcatttctaacagattagcaattaaatgtttaattgaaatatgacggtcggccataatcgtcttcatttcggtagcagttcgttggtaaattccagcaaacacattatctcttctggcatcaaataaaggcacaatgattcgaccctcgtcgttcacattagctgccaatgtctttaaactagagacaccaaccaaatcaacgtttaaagtataggccaatgtctttgcagtagttgtagcaattcttaagcctgtatatgagcctggtccttgtgccacaacaattcgttgcaaatcttctgcttccaacccagtttgtttcaaaagtgtttctacaattggcaacaactgaatgctatgattttttcgaatattggtagtcgtcatggccaatagctgattatcatccaaaaccgctgcacttaacggtcgatttgaagtgtccaatgccaatactttcataatacgtccttttcattaaaaatgtttataattactttatagttaaaaaactaacttttcgtattcttccctaaatatcttatcacaatttccatgatgaatgacaattgataaaaaagaactcgaaatcattaacgattctcgagttctccagttttagttttcgtcttcaaaaccattaggatgcttttgggtccaattccaagccgttttaataatttcatgaatatcgtcatattgtggttgccacttcaagacttctcttgccttatcgctcttagcaactaacgtatctggatcacctggacggcgggccgcaattttagctgggatttctttgcctgttgcttgacgggccgcttccaaaatttgtttaactgaaaatccagttgaggatcctaagttaaacgcattactctcattacctgcctgtaagtacttcatagccaaaatgtgagcatctgccagatcagtgacgtggacatagtcacgtacatttgtaccatctagtgtctcataatcatcaccaaaaatttgtaattctgcccgttttccagatgctacttgtaaaacaatcggaattaaatgtgtttctggatgatgatcctcaccaatactaccatcagctgcagccccggcaacattgaaataacgcaaggctacaaacttaattccataagcaacgtctgcccaatgcatgattttttccatcattaacttactttcaccataaggattgataggtgcttgaacgtctgtttctttaatcatggcattttctggattaccataagttgctgctgttgacgaaaagacaatgcgtgaaacatgattagcatgcatcgcttctaataaagtaatgacaccacccgtattattatcaaaatacttcagtggatccttcattgattcaggcacaattgaaaaagctgcaaaatgaatcaccgtatcaattgattctttttgaaaaacttgatctaaaaatgcacgatctcggacatcacccttataaaagcgggcttgcttagaaactgcctgttgatgacctgtaaccaaattgtcaataacgacaacatcttcattttgttcaatcaaccttttgaccatatgtgatccaatgtaacctgctccaccaaggactaaaactgacataatttgcctccccgtatttcataatttatgactcgattataccataacgattacacaacaaattaattagctgttactgttttccaactacattctgcttcgcaataaatttcgccattaactgtcattttatgtaacgtatttatctcggtatctgtttcatttgttttgacaacttcacttttcacaatgtgaccatattggatttccttgtgatactgaatgttcaagcgagttggaatgtgagtttgtaaaaattctgctggtaatacatcaagcagccattcaaaataatgcgaattattgacatgcccgttagtatccaaatcaaagtaacgcacaggatactcttttgaaacagttccttggtcatccgtaattttcggaacacgtggcaatctggtaatgcgtttgacttcatcactaccatatggatcaagcaattcagggattagttttcccattcgccgtgttttatgattcattaaaacaaagttactgttagcttctaataacgaatttcctgcttcatcagcaattgaaaaacgtcgttcacagaaaaatttgttatgcgcggttgcttcggttgacaactcgatggttgagccgattttggggagatcattaatggtcattaaatactgtgtgactacccatcccacaccgtactttgaaacttcttccgtaccaacgccaagttcttcgctctgatcttcagaagccaaaaccattaaatttaccaacattggaattgaagcatgataagtacgatcaccgtcataatatactaatcgatgtttctcactaaatctttttcctgccaagtggtttccttctttcattttcttgatttatctattttgaatcccgtaaatggtgataagttgcataaacatcttgtttcttcagcccacgcaattttgcaacctgtttaatcgcatcatttggtttttcaccggtactaataagattagtaacttgatcttccacagacatttctggtagagcttcttctggattttctggatgagcatttccttcaacgatgactacaaactcaccacgaatttcattatccgttgcccagtccaaaagttcctgaatgctacctcgtaaaaactcttcaaacttcttcgttaattctcgacacaaaacggccgatcggtccgcaccaaatatagcactcatatttgtgagtgttttttttagtcgatgtggcgcttcgtaaaagatcaaagtctcttctttgtttgctagtttttctagctgtcgtttctgctcagcaggctttcgatttaaaaatccaaagaaatagaacggttggggtgacaaaccagatgcaatcaaagctgttaaaccagcattagctcccggcaaaggaaccaccgagatagcttgtttcacacaagcaaccactaagtcgtgccctggatcgctgattgaaggcatccccgcgtcactaacttgagcaatgttctccccattacgcaagcgttccaccaactctggaacccgttgtctcgtattatattcgtgaaaactaatctgtttcgtttcaatatcaaagtgatttaataatttttgtgtatttcttgtgtcttccgaagcaataatatccacttcttttaatatttcaacactgcgaaatgtcatatcacctaaattgccaatcggtgttggtacaaggtaaagaattccactagtttgatttttggcaaaacttttttgtgattgcacgcttcaatctcctttaccgatctccataaatgacatcaagacaaaatgcacatggctcatcattttctcgatgcttaccaaaccattcattacaaacatgatatccacgtccgtataacttctccagatttttccgtgatttagagagaccatgcttagtgctcttttgggcttcttttttagatggccgttcgtacttctctaattgttcgcgcaggtgatcattttcaatcactaattctgcattttcttctagaatctctgccattccactctgcagttctttgatttgatctaacattttttgtgtctgatcttgaatgccattaaaactttcatatatttcccttttattcacaatctcacctcattcacagttattaaatctcagagtacctaataaatttggcacaacttgatggtcaaagattctaatacattttgaaagcttacatttcgattcaataagcttttggcctctaaggctttttcagtagcttgcatcaaagttgaagaagatttggtcatcaaggatttttcaatttgtggatcttgattaggaaaactcaatcgcaaattctgcggattgacttttaaaagcaaagcttctcgacaatataacatcacaatatcgagaattaattgttgcgaatcctttgtctttgccaaaccaatgatgttagattgcacttctacaaaagcgcgcatatctttttgaaaggtcaataaaaaccaacgactgagtgccgattgcacctgtgatagccaatcatctttaacccaattttcgacctcaactacactattagtcaagttcattgccactgcaattaaactcggcgtgatttgtttttcttgtaactgagccttaaactgcgccggaactaagggctttagctccacaacttcagtccgtgaaataatggtcggtagcattaagtttttattcgttgttaatagaaaagccgtcacattcggactaggttcttcaatgaacttcaacaaactgttggccgctccagctgtcattttatccgcatcagagataatgaagattttttgatttccttcaaccgcacttttggtaaactctgatttaagaaaacgaacttgatcaactttaatacttagaccatcaggtttgacaatgacgacatctggatgctgtccagtactaattcgtcggcattcctgacattgcccacaaggttgatttcctttcacatttaaacaaaaaagacgcattgcaatccacgttgctaattcgtcttttccaattcctgattctccagcaaacaaataagcatgtgccaatttgtgatcagcaatgatctgggcaaaatgtttgagtaactctggttgtttatttgaaactgccgtttgaattttgtcttcagtcatttgctgctcctttgttgctgtaattaaaattgttgaaatttttcaattggcataacgaatacagttgcaccaccaacttgaaccttgacaggatacgcagtggttccttccatactggcatccagattcacaggcggtgtcataaactcttctctgctatgtgaagcttccttaatcattgctaaaacttcatcaacccgctgatcgtcaattccaatcatgtaagttgtattgcctgacttaagaaatccacccgttgttgaaagcttggtagctcgaatattggcatcaataaattgatcacttaactgactagcatccttatcctggacaattgcaataattaatttcataatcttcactctcctgacttattaaaaaggcccttattagcttgataaataatcttttcaacatctgaaacaactttggctttactttgtgtggcatcaatcacttgaattcgttgtggattttgctcagctatcttaagataagacgcccgcacacgtttatgaaacgaaagttgttcgacatctaatcgatttatttcatccgttcggtgtgtcataatgcgtcgcaatccaatttcagacggaacatcaaaatagattgtcaaatctggcaataagccggctgttgcaaaaaggttcatttggtaaacttcatcaaccccaatttcacgtcctgctccctgataagcaacagaactatccacataacgatcgcataaaaccattttgccactctttaatgctggcataattgtttcgacaatatgttgtcgccgtgccgctgcataaagcaatgcttcagttcgatcatccatttctgtattttttcgatctaaaataatatcacgaattgcttcagaaatccggtttccgcctggttcacgtgtgacaactaaattatcatttaatttaggggtgaggtccgccacaattgaatttaatgccgtcgttttcccagcaccatctggtccttcaaatgaaataaactttcctgtcaacatgccatctcgcttcttaaatttagtcttttacatttcagttcggccttcaacagccttaaataaggtcatttgatccgcatactcaatatcactgccaactgataatccatgggccaatcttgtaactttgatcccagctggtttaatcaaccgtgataaatacatagccgtcgcttctccttcaggtgttgcattagtggccacaatcacttctttgatggattgattggtttgaagacgcttcaaaaggctagagatattcagatcttctggtcccttaccttccattggtgaaagcacaccttgcaacacatgatacagaccatgatattctttcatctcttccatagacatgacgtctttgggatcttccacaactaaaacagtcgcttgatcacgactcttatcacggcaaatttcacacggatcatcctcggtaatgttgccacaaatactacaaaaatgtaaatctcgtttagcggagactaaggattttgcgaactcactgacgtcgtcttgatccatattaatggtaaaaaaagccaatcgggtcgcacttttttcaccaatccccggcagcttcatataactatcgattagttttgcaattggctctggatactgcatttattaagccctcattcttacattctaggcaaaccttttgtgtatttacccatcgttttattagtttcgtcggtaatctttttcattgcatcatttactgctgctaccactaaatcctgcagcatatcaacatcatccggatccactgcttctggtttgatcgcaatatctttcattgtcttatcaccagtaaaagtgactttgaccatatcatcaggggcaactcctgtaaattctgtcgcatccaaattatcttgttcttcagttacctttttttgcattttttgcatttgtcgcatcatattttgcatatttcccattccaccgcgcattttaactccgcctttctgtttaatcgtctttgatttctaccgtttcactgccaaacaaagcttctgccttcgtcactaacggatccttactttcttgtagatcgccatccgttccctgctcgctttcagcaggaggctcttccacatcagatgtcgcattttcattattactttgcagatctgctttatgctgttgaatgtacccctgacgaatttctggccattgatccgcatccacataagcaattttcaaatcatgaccgactagcttatcaatatcgtcactcaataattgacgaagatcaccgtcatcagccgcctgttcatacaagaaagcgtaattaaacgcaattacagcccctttttcacttgctgcgactggttgtgccacatgcattaaagcgcgctgtgtcacacttaacattgacattaaatccggccagatctcctttaattgtaccaaattttttttggttgcgttctctaaaactggataaatctttgagagatttggtttaacttgccgtccgtgtttcttgggaccattactgcgattgatattattagtgggttttgaagctccggtacttttttggctttctaactgtttgacttgatcagccaactttttgacctgatcttctagccgtgtgacttcagcactgtcagtcacaggtttttttgcttgtttgactggtgctttttctgcacccgaattagttgccggtgttgtcggctgcgccaatttgattgttaaaacttccatatagacgtccggatgtgtcgtaaatcgcatttgttgctgagtattatttaaatgatcaatcattttatagatacgttcagctgaaagagaagcagcaaatgttttaaattgatcatcaacatcgcctaactcttggtcaacaatcaacgttggatcctgttgatatagcagaagattccgacaaaaattaatcaaatcttcaataaaacgatttgcatctttaccttctgccaaaactttttctaaggtttccagtgctgcgctcacctgttgatccgaaatttcggctacatatttatttaacagatcgtgattgacgctgcctgtaacttgaagtgcattttttaatgtgatttcattatcaccaaatgacagggcttgatccagaatactaagtgcatcccgcattcctccttcggcagctttggctataaccattagtgctttttcatcatacgtaattttcttttgacccaagatataaaccattcgatcaaagctatctttcgttgaaatacggcgaaaatcgaaacgctgggttcgggaaataatggtgagaggaatcttttgaggctcagtggttgctaaaatgaacaccacatttgctggcggctcttctaaggtttttaagagcgcattaaacgcacctgttgacaacatatgaacttcatcaatgatataaactttataatcagcttcggttggtgcgtattttgccttgtcacggatatcacgaatttcttcgacaccattattggaggccgcatcaatttcaatcacatcgtttaagcgtccttgtgtaattgctttacacgttgcacattcgttgcatggctcaccatcctttaaatggtgacaattaacagccttagcaaagatcttagcagccgatgttttccctgttccccgtggaccagtaaacaaataggcatgactagtttgcccagtaatgagtgcgttttttaaagtttgggtaatgacttgttgtcccacaatctcgtcgaaacgttgtggtcgccaaacacgatataaagcttgataactcatttttgaattcccttcaatcgtttctataaacctaaataaaaagctcctagccatgttgactaagagtttatcaatttcccaataacttaaggcacaagacagatcagacttagtgctgcttccttccggatctgacacaattcgtaagtccacccttgccttaaggcctctcggcactattaataatactcgattttactcagaatttctactaatttgtttacttttttttatgttttttcttcgagcccgaatttctcggaaaaagttttgcataatttgactcgcttctttttgaaaaagtccttcgtgaacttgcacttgatgatttaatcgtcggtcattcaaaagctgatacaagctttgcaccatgccagctttaggatcccgcgctccaaaataaacctctggtaattgagaattaataattgcgccactgcacatcatgcatggttcaatagtgacaaagagttgacagtcccaaagacgccagctctttaacgtatgacaagcttcttgaatggcaatcaattccgcatgggcagtggcatcttgatctttttcccgcaagttatgtccttgaccaacaatttgatttttatgaacaattatggctccaattggcacctcacccatgcttttagcttttttggcttcttcatacgccagactcataaaatataattcttggttaacagataagtcgttcgccattactgggactccttcacacttttaatgatgtaataacctttttgtttatgaataatttcggcattgccaaaaacttgttccatcttttttttggccgatggcgcgccctgctttttttgtaaaacaataattaaagagccgccaacttgcaaatgattttttgcttctactaggatcttcgtgacaactgatttaccagcgcgaaccggtggattagaaacaacagtttgataggtggtcttctcaactttatcatacgtatccgattcccaaattgtcacgttatgaatattattttgctcggcattttctttgcacaaatccaacgcccgtaaattaacgtcaaccaaatcaacatgaatttctggaactgccttggcaattgctaatccaatcggcccataaccacaccctacatctaaaacctctcccgtaaattcttttaaatttaaagcttccagtaaagttcgcgttccaaaatcaaccgtggctttggagaaaacaccgttgtcagaattaaaagttaaattttgattcaataatgtaaattgccactgtcgtttctcatgtaaaacttctggattttgtgtataatagtattcagtcattattttctccttctttataggttctattataaaggattatcttgcttaatacataactaacttagcgttagattctccatcaaaaagtgaacaaaaaaagttttgcttcaaagccttattaaaccaccacatttagtgtagtatcaaaaaaacacactaaatatggtggtttttcattgaattttacattgaatgctgtatactgaatctatcgtataaacataaaagaaacagagaattgaaggtgattacatgagtgaagtaacaatttatacaaaaaacaactgtatgcaatgtaagatgacaaagcgtttcttaagcgaacataacattccttttaaggaacgtaatattaatacaaatcctgattatatcgactatttaaagtcacgtggattccaagctgttcccgttgtagaatcaaacggtaatgaacctattgctggatttcgacctgacgttttaaaacaacttgctatttagcaacctatatatttatcaggctgggtaaaacgcacgtgctgcatattacagctaggcgttttttatttacttaaaatttagtatttatcgcagaaaggcgtgaaattatgagtctcaagaatcttaaagatgtcacatactatgatttaaataatgaaattaacattcctgttaataatcagatcccactaaacaaagaccatgatgcattggccgccttcttagctcaaaatgtcaaacctaacaccaagaaatttgattccttgcaagctcgttttgactacctcatcaaaaatgactacatagatgaggattccatcaacaaatattcaccagagtttctcgaaaagctttatgcttacttgaatgcgcagaactttcattttcaatcattcatggcggcctacaaattctatgcgcagtatgcgttaaaaacaaacgataatagttattacttggaaaactttattgatcgcgttgccatgaatgccacttattttgcggagggtgacgaaaacttagcaatgaacattgccgatgaaattattcaccaacgttaccaaccagcaacccccagttttttaaacgctggtagaaaacatcgtggtgaattggtttcttgttttttgatccaggcaacagatgacatgaatgctatcggccgaacaattaattcagcactgcaactgtctaaacttggtggtggggtcggaattaacctcagcaacttacgagaggccggcgctcctattaaggggattgagggcgctgcaagtggtgttgttccggttatgaaacttttggaagacagtttttcatacgctaaccagcttggtcaacgacaaggagctggtgtggtttatctcaatattttccaccctgacattatttctttcttatctgctaaaaaagaaaacgcagatgaaaaaattcgggttaaaactttgtcacttggtgtcgttgttcctgataagttttatgaattagcacgaaaagaccaagacatgtaccttttcagtccctactcagttgaaaaagtatacggcaaaccattctcatatgtggatatcacaaaagagtatgacaacatggtggctaatccagaaattcggaaaacaaaattaaaggcccgggacctggaaaatgagctttctaaattacagcaagaatctggttatccatatgttgtcaacgtcgataccgctaaccgcgacaatccaatttacggaaaaattgtgatgagcaatctctgttcagaaattatgcaggtgcaaactccttctgaaattgatgacaaacaagaatacaccacattgggaaccgacattagttgtaatttaggatccactaacatcgtcaacatgatgaacacacctaattttggtcactcagttgaaaccatggttcgcgctctaacttttgtaacggatcattccaatattagcgtagtgccatccattcaaaatggaaatcatctttcccatacagttggattgggtgccatgggacttcatggttaccttgccaagaaccatatgtactatggggacgcagattcattggactttaccagcgtttatttcatgctattaaactattggactttaaaagcttccaatgaaattgcacgtgaacggcaaacaactttccacaattttgaaaagagcaaatacgctgatggtagctattttgataaatacgttgccaaggactggggtccaaaaactgaaaaagcaaaggaattgttcaagtcaattgaaattccaacacaagccgattgggaagccttaaaagaatctgtaatgaaagatggcctttatcatcaaaatcgaatggctgttgcccctactggttccatttcttacattaacgatgccacagctagtttacaaccaattgtcaaccgagttgaggaacggcaagaaaagaaaattggtaaaatttattttccagctccataccttgataacgatacattgccatattatcaatctgcttatgacattgatatgcgcaaagtcgtggacatttatgcagccgctcaacaacacgtcgatcaagggatgagcatgacattcttcatgcgttcaaccattccggaaggcatttatgaatggaaagatggccgcacaaacaaaatgacgactcgtgatttgaacattttgcgtaattatgcgtataataagggaattaaatcaatttattatattcgaactttcactgacaatgacggtgaagttggcgttaatcaatgtgaaagctgctcaatttaattacgtttggaaaggaactaaataatggcagatttaaaattagatccaatgaaatggaatgcagatggtaactacaaagccgtcaactggaatcaagtttccgatgaaattgataaagcaacttgggaaaaattaaccgaacagttttggttagatacccggattccaatttcaaacgatcttgacgactggcgtacattagatgaagatcacaaatgggtcgtaggacacgtttttggtggtcttaccttacttgacaccttacagtcgcaagacggaatggcagccttacgaaaggatgtccggacacctcatgaaacggctgttttaaataacatccaatttatggagtccgttcatactaagagttattcatctattttcgaaacattaaatacaccaggcgagattgatgaaatcttttcttggagtgatagtgaagaatttcttcaaaacaaaaccaagaaaatttacacactatatcatgacgacagtgacccactcaagaaaaagatttcaagtgtcttccttgaaactttcttattctattctggtttcttcacgccactttactacttgggccacaacaaactaaccaacgttgctgaaattataaaattaattttacgtgatgaatctgtccatggcacatacattggttacaagttccagttggctatgaagagcttatctgaaactaaacaacaggaattaaaagactggatgtttaactttctttatgaactttatgataatgaagaaaaatacgttcacgttttatatgaccaagttggttggtcagatcaagttttaactttcacacgttataatgccaacaaagctttgatgaacctgggccaaaatccactcttccccgatacagaagccgatgttaacccaatcgttatgaacggaatttcaacaggtacagctaaccatgacttcttctcacaagttggtaatggttatcgcttaggtcaactcgaaacaatgtctgataaagattatgatattggtaaacctaaagaccataagtaatgaactaaaaagaatgtctctaagttttctaacttagtggcattcttttttctatctttaaggagcaaagattatgaaatcgattcgatcaatttgtgtattttgcggctcaaacacgggctacgatgaaaattataaaaaagcaacgattgcattggccgattatttagcggtgcatcattatcgtttggtctatggtggcggacgccttggtttaatgggcgttttaggcaacgaaatgttagacaagggtggtgatgtccttggcgttatccccaaggtactggtcaatgaaaaactagcccggattccaagcgataaaattatcactacagtagacatttccgagcgcaagcaatacatgttggacgcttcagacgcttttattgccttaccaggtggctttggaacttttgaggaatttctcacaatgttgtcttggagccaaatcaatctgcaccaaaacccattggctttactcaatgtcgatggtttctacgaccctctggttcaatttctaaaacaaactactgaagctggctttgcgcctaaagaaaacttaagcctttttgttaactctgataacgtccctgatttgtttgcccagcttacaacatttcaacacacactacctaataaatggacgaattaaatgtctaatgtttccacataaaataccgatgtcgaactgatttttgtcagttttagcatcggtattttttaaaactaattttcttttaaaatggggtaaaaatgaacgttctgaaacatgaaggaaagacttttttcaagattggttttctcgtttttatctaaaacggatgtaatgcaaaaaacggccttaccagttttaaaagtgtcctctatgtactgggaagcttcattagagaatttcggctctttttttgcaggctctcccaacgcaataaaatactctagcggcaacttcagcagtgaatattccgaaatatgcgtagatggagcattatagcttgagccacattgttcggtcaaaatatgatgggtaatcgttaataaatcactcataatactgtttgccgttggctcagaaccggctcctgctcctgtatacgacgttgttcccagagcagtactcgtaactaacacactattttctacgccactcacattggcaagcggatgctgtttcgtaactgccacaggcgccactaacgtgtataaggtatgctccttttttcaggcaacaatcgctggcttaatggtcaacccccagtgtgccgccccactgagctcatccaacgtaattttatcaattccagtgcgctctaattgttttaaattaatcgtatgcccaaacgctaactgacttaaaatagccaatttataggccgaatcaaagccactcaaatcattaattggattggcctctgcatatcccaatttttgagcgcgtttcaaactgtctgcataactagaacgttcatctttcattgcacttaaaacgtaattcgaggtcccatttacgattccagttaacccagtaatttgatcggtaattaagctgtcactcaaaacccgcaaaattgggattccaccaccgacactcgcctcatagtaaagatctacatgattttgtcgtgctagtttggtcaactggggaccttttaaagcaatcaattccttattggcagtaatcacagattttccgtggttaatagcttgacaaactgcgtgataggcttggtcaacggttcccatgacctcaatcacaatttgaattgaaggatcagttgtgacgttttcaatttcaccagtaaattgaacatcttcatcccagtgcaaatttcttttcttgtcaggatgactaacagcaattttcttaacattaaaatgaacttttatagactccgcaatctgattagtagcacggtttaataacgtcaagacacccgttccaacggtaccacaacccagcattccaaccgaaatagttgtcatcacaaagacctcctttagactcaaatttttgcaaatgtattgtcagctttagaaattaagttaagccaattttgatagataagttgacgactattttgccaagtatagcgaatgcggccgtcaccatcaaagtagttttttggagccaatatctgttcctttttatttaaatctcgtttatattcaacttctagcgtatctgcttcatactcagggtgaccagttaaataggtttgattaatctgaggagcatgtagaatcataggtccaatttcagcattacttgcaaccactttgacaccagaaaagtgctcaatcgtggtatgccgtgattgtggtatttttaattctttctttttcctgattccggtaacaagcggactttctttatcaatctcagtcgccgaataaataccaaatgttttctcgtctaaattcacttttttaatattaaactcgactgccaaagcggcctgagcagcccaacattcaaataaggattgcttaacatggtgatgggaccaagcaataatttgtttaaattattgccaataatcaacttgatcaaaagttaacgtttcaattggcgccccggtaataattaaggcatcataattattttttgaagcttcactaaacttggtataggatttcgccattaatgccgctgaagtatttttaaagctatggctggccggataggcgaaggtcaagctaacatcttgtttcatgtgattgaaggctttcagaaactgccgttcagttgttttctttgttggcattaaatttaacatgagaatatttacaggattgcttaacctgacattttgccattcttgataagcctctaagaatccgttttttgcgtttgctgtcatccacatcaccctcctattgacaaaaaaagtcttcattccataatcttgtataagattatgggacgaagacattcgcggtgccacccaatttttcaatatttttcaatattaaactcagcaagcactcccataataaatcggaatgctctgtaagttatcggttactaccggacaaccagccagttaacgagcagttgtcaattccgagctcatcttcagactttttccccacacctcattgcaccaaccgaggttctctttaagaaggtttccaatcttactcttctcatcaacatctaatatttttaacttttacttaacttaacattcacttctcccaatgtcaataatggattcgaagtttatttgaagataaaaaaagaacccacaattgtgagttctttttggatgttaacagattatttaacagtaactgtagcgccagcttcttcaagcttagctttaacatcgtttgcttcgtcttctgaaacgtcttctttgattgctgaaggtgccttgtcaacaaggtccttagcatctttcaagccaaggccagtgatttcacgaacagccttgattgctttaactttagctgatccagcctctgttaattcaacagtgaatgttgtctttgcagcagcatcgccaccagcagcacctgcggcagcaactggagcagcagctgaaacaccgaattcgtcttcgatagctttaactaagtcatttaagtcagtaattgaagcaccttttaagtcttcaataaattggtctttatctaatgccatttttgtttcctccattatatttgtctaatttaattatgcagcgtcttcttcagactttttatctgcaacagctttaacagcataagcaacattacgtacaggtgcttgtaatacattagcaagcatgctgagcaagtcttcacgactaggcattgaagcgtatgtgttaatttcatcaagtgtagctacttttccttcgatcatgccacccttaagtgtaagtgcgtcatgttcgtcggcaaactttttcaaaacctttgcaggtgcaactgggtcctcatcagagaatgcaacagcacttgggccaacaaaaatatcgtttaactctttgtaaccagctttttcagcagcacgagttaaaattttgtttttaattacatgcaacgtaacaccagcatcacgcaattccttacgtaactctgtgtcttctgcaacagtcaatccacgtgaatcaacaacgattgcggaagcggctttgctaaaataatcaacagctgtatcaacaattgcagattttttagcgattgcttctttactcattaaatttcacctccagcaattttttaattataaaaaaatccgcacccagacgggatacggaaatttacatttctacgttcctcggcaggcaaaaaattaagacgatcactcgtcacctgagtcttaggcaaattttattataatttactaatcaaagttaccatagaaaagctatctatgtcaatacacaattaattaaaactgtgataaatcaacatggacaccagggccaaatgttgaagctacagaaacgttttgtacgtatgttcctttaacagaagcaggacgtgcacgaacgattgtatcttcaataactgtcaaattaccaagtaacttgtcagcatcaaatgacaccttaccaattggcacatgaacattaccatcacggtcagttctgtaagtaacttttccagctttagattctgtaacagccttggttacatccattgtaactgttccggtcttagggttaggcattaaacctttgggtccaagaacccgacctaaacgtccaacctgagccatcatatcaggtgttgcaattgcaacatcgaaatcaagccagccgccttggatacgttgaactaaatcatcgtcacccacaacgtctacgccagctgcctcggcatctttagctttttcacctttagcaaaaacgataactgtttgttctttacctgtaccatttggtaaaacaacagcgccacgtaattgttgatcagcttgttttgtatctacatttaatttgaaaactgtttctacagttgcgtcaaacttagcaaaatccattttcttaactaagtccaaagcttcctttggtgcatatgcttttgttgtatcaacttgctttaaggcatcttgataccttttacctctttttgccatctgtgttttcctccttgcaaatgtggttttatcggattttcctcccacttgatacatccattttaatggagtatccgactacaacaacttagtctttaacttcaaagcccatgctgcgtgcagtaccttcgaccatgcgcattgcagactctacgtttgcagcgtttagatcttgcatttttgtttcggcgatttccttaacttgatccttggttacagttgcaaccttgtttgtgttaggttcaccagaaccatgttcaacaccggcagctttcttcaagagaacagaagcaggtggagtctttgtaacgaaatcgaatgaacgatcttcataaactgtgattacaacaggaattaacatgccagcttgatcagctgtacgtgcattaaattcctttgtgaatcccataatattaatacctgcttgtcctaaagctggaccaactggtggagccggagttgcttttccggcaggaatttgcaattttacaacgttagctactttttttgccacgagacatacctccttataagtccgtgtgtggtatgatgaggatttaaatttcctctcccacgcttacatatgcacaaaagcatactttaaaagtataccatgtaattatcaaaaggacaaacccctaatccagtttgtcaatttgctccatatcaagctctgtactcgtttcacgaccgaacatgttgatattaactttcaatttcatatttttattgtcgacttcagtaattttcccggtcaatccagagaaagcaccatcaacaattttgaccgtttccccaacttcaacttcaattgtggcatgccgtactgacatccccaaatgacgaagaattcgttctgcttcatctggcaacaatggagatggtttactacctgaaccatgtgagcctacaaagccagtaacaccaggagtgtttcgcacgatgtaccaagcttgatcgctcatgaccatttccactaaaacatatccaggaaattcctttttcattgtaaccttgtctttgccatttttgttttcatgttcctcttcttcaggaacaactactcggaaaatattatcttgcattcccattgatagagaacgagattccaagttagctttgactttgttttcatatcctgaataggtatgcaaaacataccaattttttgcagctgtttccaattgtatttctcctttgattttaaacaaaataaaaaaactccgtctacacgaagttccaacacagttattgtatcaaaaaaaacgatctagtgccatgcttttactggaataaagcaagaaaaagttgaactaaccagtccaccagtgcaaagaaagcaacaaagaatactgagagtccaatgacagaagaagcatctttgcggagctggtgtgcatttggccaggtcacatcatgcatctcttgtataacacttttaataaatttcattgaactttcctcctagcgtgtttctcggtgtaacgtgtgtttgttgcagtgtttacaatactttttaacttctaatcttgtagttctgtttggattcgccgcaactgtatagttccgtgatccacaaactgaacatgctaaagcaatttgtttttgcgacataatttatctccctaattaatcaaatctaactttatcatgccagctccaccatgtcaatttcaaccaattaataaaattgatgacagtaaaaaataggacctgagtcctatttttatttaccgatcatgagaaacacgttgttcaaacttgctgcgacaccgactaattgcgtttaaaacttttgaacgatcacaatttagaatagtcgcaatctctgctgaatcttttccggcaaaaaagtgacgaaaaacttgtgcttcaaacccagaaagatctgaacaatagcgttcacaatcttccttcaatactgccatttcgtgtggtccaccatgtttggtcatgaacaaacgctcacagtcactattctcttcttgcattgcctccagagaattgctaaataaatctgaacgccgtttgaaggccatttctcgacgaataagactgcagacccgattttgaaaattggtttgaaagaattttcctaatgtaatatgccgttcactgtcgtagttcgcgatcgtattaaagaaagacacccttccctcctgtaaccaatcatccaattcgtatcctcgtaaaaaatacttttccttaatgtgaagcacgattggactgtactgatgaaataatagttcaaagcttgtagaatccccatattttgctttatcaattaaacttaactcagtttcgtacgtgttgtttgtcatgtgtcactcctaaccagcctcctcgagaaaataatataccagattaagtatttggctggcaagggaacacacgtttaaatcgttgatatgacgcggattatagccacaaaaaaagcaaaattcactgtaaaacctcgcagtaaactttacttttgtcggagtaatcgaattttttgtcgtactttttataaagaatggcgtgttgaaaatccttgataaattaataaacttgccgcaacactggcattcaaactttgcacttgccccaccatcggaatggtcaatgtttcatcaacctgtttcttcaataaaggtgagattcctttaccttcattaccaatgattaagcccactgatccttttgcatcccatttacgataatcagtaccatccatatcagtaccaaagatccacatgccgcgcttttttaattctttaacagtattgaccaagtttgtgacacgcacaaccggcacgtgctcaatggcccctgctgacgtttttgccacggtactagtcaagccaactgcacggtgttttggaataatcacaccatgaacccctgcggcatcagcagttcgtaaaattgaacccaaattatgtggatcttcaatattatccaagataacgacaaatggcgcttcgtctttatcactggcttttttgaaaacatcgtccaaatcagcatactcaaaagctgcaatggcaagtacgacgccttgatgattttgtccatcagataaatggtctaacttatgtttaggcacctgtgacacaataagtttgcgtttttctgcaagtttgacaatatcgtgaattgcatctgcttttaagccttcttgaatgaacactttattgattgtttgttgcgactttaaagcggaaactgctggatgacggccaataataaaatcaccttgcgtctctgctgcattctgatcttcgtttttactttgtggcatgtgtaatttttccttcctctacttgtgcaatacaccagttagcaagccaatctaagcgttcctgctgaccacttaaagaaagataccccattagtgcttcaaaccctgtggaaatccgatacgtcaaaacggaagtgtttttagcggaagtatgacttttagcattacggccccgtttaaaatacgcttcttcagtttcagttaagattttttgcgccttcatggcatcaattaaagctgcctgtgcctttgccgaaacaaagttggttgccgtatgatggagcttagttggctttgtcaggcctttttgaatcaagtgtcttctgatgtaaacttcgtatactgcatcacctaagtacgctaatgcaatgccatttaattgtttataatcgtcatattctgtcattcgatattattcccttttccaccgagttccttgaggggtgtcctccaagataattccctggtcttttaattgatcccgaatttcatcactacgttgaaagtccttgttttctctggcttgatcgcgttgtgtaatgagttgtttaatcgtttcatcttctaattttgtttcttctaatttaattccaaaaatacttaccagttcaataaatcgagcctttaacaaatctagtgagtttcgtttaacggtttcgcgttcactatacacatttaaaactttggccaattcatacacaaccgcaatcccattttgggcattaaaatcatcatccatagcctgattgaaatcgtcagttaattccttaacccgcgttgctatttcgggattttcgccatcaattgcatctgcataacgataatttagattggcaaaggcattttgcagtttagctaaattattaccagcttcagccaaattttctcgtgtatattgaattggacgacgatactgggtagtcgccataaacaaacggagaatttggggatccatttctttaataatatcgtgaacagtcacaaagttgcctaacgacttactcattttttcattttcgtcgccaaccgtgacaaaaccgttatgcatccaataattagaaaaggttttaccagttttggcctcactttgtgcaatttcattttcatgatggggaaactctaaatcttcaccaccagcatgaatatcaatggtttcacctaggtactttgtggccattacggaacactcgatgtgccaacccggacgacctttaccccaaggtgcttcccaagaaatttcgtctgctttgacacctttccataacgcaaaatcaatgggatcttctttacgggctgtttcttcatcatttacatgttcactggcgccttgttccaaatcatcaatattttggcccgaaagttcaccatactttttaaatttgcgagttcgataataaacatccccgtcagacacatatgcataacctttatcgagcaaaacctggataaaatcgatgatttctgcgatattttcggttgcccgggggttcatagttgccggttccacattaattgcgcgactatcttccatgaaagcctgaataaatttatcagctaatttgggaaccgttgtcccttcttttttagcggtattgatcattttatcatcaacatcggtaaaattagaaacaaaattcactttaaaaccacgatactcaaaatagcgtcggattgtgtcaaacgcaatgatgctacgtgcattaccgatatgaatgtaattatatacagtgggaccacaaacatacatgttcacaatcccgggagtgatgggctgaaacgcttcttttcgtcgcgtcattgtattataaacgtttatcattcaaacggcctcttttcattttatattctgttttgattttatcacatatcccagaaaccacctaaaaaaggattgtgtgaagaaactcatctcccacaatccttttttattacttatccagttcatcaatcattgctttcaagtgagacattgcggtcttttgacccaaaagttcaatggtttctggtaattctggtccatgcatttcatgggtaatggcaattcgaattggcatccataacgcacgccctttaacaccagtttctttttgaaccgccttaatagcagctaaaatttcgactgtatcaaagatttccatcttatcaaaccgagcatacattgcctttaaaactggcaaggcagtgtctgccgaaatttcttgcttcgcttcttcattgatctcatcaggaccattgaagaacaaatcagccatttcattaatttgcgcagtataactcatttgacgtttataaacgttaattaatttacgtgcccactcaacccgttctggttcaggatttttttcaatgttaccagcctttatcaattgacgcaaagcggaatccatcactttatcttcatcagccgtcttgacgtattggttattgatccattccaattttttgccatcaaaagttgcaggtgacttactcaaacgtttttcatcgtacattttaattaattcacgttgggtaaagatttcactttcaccaactggtgaccaaccaagcaaaacaatgaagtttaacatagcatctggtaaataaccgagtgaacggtactgttcgataaactgaagtacactctcatcacgtttacttaactttttgccagtctcattatttatgattaaactcatatgaccaaacttgggtggctgccagccaaatgcttcatagatcatcaattgttttggcgtgttggcaacatgatcatcaccacggaagacatgcgagatttccattttatgatcatccaccacaacggcaaagttatacgttggcatcccatcgcgcttttgaatgacaaaatcgccaccaattgtacttgagtcaaatgaaatattgcccttaacaatgtcatcccaggtataagttttgtgttctggaacgcggaaacgaataactggttctaaaccagctgccttagattcagcaattttagctttgatttcgtcatcgctcatcccagcgtattcataaacataacgaggcatttcgccacgtgccttttgttcttcacgttgtttttgaagctcttcttctgtctcataagattcataagccaaatttttgtccaacaactcttgaatcaaaggttcatatatagcctttcgttcagactgacgataaggaccataatcaccaggcttatcgggaccttcatcccaatccagccccaaccattttagattgtccagctgactacgttcaccatccttgatattacggctggtatccgtatcctcaattcgaataataaacttgcccttgtaatgacgtgcaaacagataattaaacagagctgttcgtgcatttccaatatgcaaatgaccagtaggacttggtgcataacgaacacgaatcttactttttgccaaaattaacgcctctttctaagtttttcacattttattgcttaatcaattgtacaattgccactcaaataaataaagccacaatcttagctattttctgagttacgctcactaattcctcgtgtcgaatgtaacggttttgcgaaaatcattcgcccggcatctgtttgaagcgcacttgtgacaacaacatccaattcttgattaatgaagtacttaccttcttcaaccacaaccatggtaccatcatccaaatacgcaactccttgttgccgttctgttccgtttttaaccaccatcacatgcaggttttcaccaggaatgacccgtggtttcaatgcattggctagagcgttaatatttaatacttgaacattttgaaattggctcactttgttgagattatagtcattggtgacaatcaccgcatccttatcctttgccaatcgaataagtttgctatcgacttcatcaatttcttcataatcaccttcatacatttccaccgggataacatgatcactttgtaatttgtttaaaatatccaaaccacgacgaccacgtactcgtttgatactgtctgaagaatccgcaatatattgtaattcatacaaaacaaagttaggaaccagtagcgttccctcaataaaaccagtcttaatcaaatcataaattcgaccgtcaatcaaaatattggtatccaaaattttatagtgatgaaaattatctgaatacttgcgatctaagacgtttttggcattctcaggttccttacgacgcgtgaacaatttacgccattcgtcagcctgtgtggttccaatccgaaatcccaagtaacccaaagtcaacattaaaatgatgggtacaacagtattcaaaaagaagatttgttgacgataaaacaatgttgaaatcaaaattgccaaaaccatcccaacaaccgttgataagcttccatatagcaaacggaccggtggaatctttgaaatctgtttttctaagcgacttactaatcgttcaatgtagccggctaagaacagtgaaataataaagaaaataattgctccaaccacgaaatttgtaactgaattacttagccaccaatgattacctaacgacaataacagccataatggtggtaacaaaatagcacctagcgcaccacctgctaacgcaaaaacggccttaataatattccttttcattaaacatccctcctttcaaatttaaacctactatttaaaaattcttcgcaacgcatctgacaaagttgcgacacccacaacctcgataccagttggtggtgtccatccttgaaggttgtttttaggcaaataaatacgtttgaagcccagcttttgagcctcagccacccgttgttcaattcggtttacccggcgaatttcacccgtcaatccaatttcacccacaaatgcgtccatcgggtccgttcccttatcgcggtaactagacgcaatactaattgcaatagctaaatcaattgccggttcatccaacttgacaccaccggcagcttttaaatacgcatcttggttctgcagcaaaaaattagcccgtttttccaaaactgccataatcaaagaaactcggttatgatccagtccactagctgtgcgttttgcattaccaaaagtagtgggcgtgattaaagcttggacttcaaccaaaattggtcgtgtcccttccattgaaaccacgatggcggaacccgtagcatcttttagccgttcttccaagaaaatttctgaaggattggcaacctcttgcaaacccgtttcacgcatttcaaaaattcccagttcattagttgaaccaaatcggttctttacggcccgaagaatccgataagtgtgatgcaaatcgccttcaaagtaaagaactgtatccaccatatgctccaagatcttcggccccgcaattgcaccgcccttagtcacatgaccgacaataaaaattgtaatattgttagtttttgcaatctgcatcagttcggcagtgatctcacgaacttgcgctacactaccaacagcagattggatatccggctcctgcattgtctgaatcgaatcgataatcacataggttggtttgagttctttgatagccgcttggatgctattcatgtcagtttctgggaacaaataaaaattctcactagcaacatgtaaacggtcggcacgcattttgatttgggcagcactttcttccccagatacatataaaacgcgatgctttgtttcgcttagttgaccagaaatttgcaaaagcaatgttgattttccgattcctggatcaccaccaatcaaaacaagtgatccagttacaataccaccgcctaaaactcggttaaactcatccaaacctgtttttacacggggagtttcactcatatcaacttggctaattagttgcggtttggctcggttaccttcgaaactaactcgagctttgtgattaactttttcgctttcaacccgctcttcaaccaaagtgttccattgaccacaacttggacaccggcctaaaaatcgaggcgaaacgtagccacaattttgacagacaaactgagtcttttcttttgccatagtagtatctgctcccttcaattttagcatattcttaccaaaacaattggtttgaaaatatctttataaatctttaactaactacttaccagatgaaccaaaaccacctactcgtttttcagctcgttcatcttttccgtcggcctgtaaataggacatgaagattccctgtccaatccgttcaccttttttaatggtaatatctcttaaccccatattaatgagttgaaagtaaatttcaccttcattgccagcattattatagtaatccgcatcaataatccctacaccatttggcagtatcactcctcgtttcaaaggactgctagaacgatttgcggccaacaaaaactcgtcatcttgcatatatgctttaattccggttggaaccaagaaaggctttaggtccttactaccattcaccaagtcagtttcactgactggtcgcttatgatgtagtgaccagagcacctttaaaaagttacctttccaaatagagggtaaaacaaaatcttcagccgcctcaaaatcataacccgctgcgtgctctgtggatcgatatggaagattgagatttttatcttgatatttagaaacaatttcaaaaccacgcttcatacttaaaaattcccttcttattcatctaatgattaatttcgcattaaaaggttcaatctttgtatattatccgtttgaaatgccgttttgtaaactaattcatttaaaaaatagggaaatttaagtttcctaattgactttgcaaaattcggaggtgacaattaaggggaattaacaatttgacaaggaagtgttgggatgaaattcactaatgatggtcagaaaattagttttaactatcaagataaaattggcgggtgcgtcacctattttccaatccgtgatgaccaaaccttagttattgaacaagtttttgtgaatccagcattacgtgggcaaggcatggcacagcagctcatgattgaaatgctaaattttgcaaaacaacagaacaagaaaatctatccactctgtccatatgcccgtgcttatttgaaaaagcacttggaataccaagctttaattgaaaatcattcggaagcagaagttcaaaaagaaaaggagaaaagtaatggatcaaaatgaactcaaaaaattagttggtcaagaagctgtcaaatttattcaagataacaccgttgtgggtcttggaactggatcaaccgtaaaattcatggttgatgccctaggtgaacgtgtaaaaaacgaaaatcttcatgttattggggtccctacctctaatcggacagctaaacaggccggatcactgggcatcgaagtaaagtcggttgatgaagttgaccacattgatctcacaattgatggagccgacgaaattagtgcagattttcagggcattaaaggtggcggtgcggctcatctttttgaaaaaattgtcgcaactaactcaacaaaagtcatgtggattgtggatgaatcaaaaatggttcagacgcttggaaaatttccacttcctttagaagtcattccctatggtagtcaacaggtttataaaaagcttgccgctaaaaacctccatcctgaatttcgattagacgaggctggcaaaaatgtcctaaccgattcaaaaaactacgtcatcgacttacatctaggcaaaattgaacatcctcacgaattggctgattatctgatcaaacaggttgggatcgttgaacagggcctgttcttagatatggtgaataccatcattgtgggtcgccagaacggtcccgaggttattcaagcccgtccctaaagagtttttaatcaagatttaagcatttactaattattctttttcgactacaatgtttatatattaaaggttaggagtgaacaaattgagtaataatagtatttctaaagatcaagttgctcgttacgcaaaaaattataacgaacaaaacaagtctaaagtccttgaacgcgcggttactaagaacggtatcttagcggctagcgaaggccttcgtggcggtgctgatttcagtcccgttttctcaattgacttagagacaggtgctgttgccaatcagaagcaaagtggccgttgttggatgtttgccgcattgaacacgatgcgtcatcatttatctgaagaattcaagatcaaagattttgaactttctcaaaactacactttcttctgggacaagtttgaaaagtcaaactggttctacgaaaatgtcatcgctactgctgacaaaccaacctcagatcgtaaggtttcatggttgttaaacgaacctcaaggtgatggtggtcaatgggacatgttatgtgccctcattgataaatatggcattgtccctgaatctgtttaccccgaaacttacaacagtaacaaatcaaacgaattcaacactttattaaacgaaaaacttcgtaaagatgccgttgaattacgcgaacttgtcaacaatgctgaaacttcagatgagcaagttcagtcacgtaaagaaaaaatgttggaagaagtttaccgcatggcttcatacagctttggtgaaccacctacaacatttgactgggaataccgtgatgatgacaaaaacttccatcgtgaagctggattaacacctaagtcattctttgaaaagtttgttggttgggaccttaagaactatgtttcaatcatcaatgcgcctacagatgacaaaccatttaaccacacatactcaatcgaaatgttgggtaatgttgtgggtggtcgtcaggttaagcatttaaacttaaatatgcatgacttcaagcaagctgctatcaaccaacttaaggctggtcatagtgtttggtttggttgtgatgtcggtcagcattcagaaccaagaaaacgtggtttattggatcttggcgtttacgatgaagaagctttgtttgatattgatttatcaatgtctaaggcagaacgtttggattacagcgaaagcttgatgactcacgcgatggttattactggtgttgacttggttgacggcgaaccaaagaaatggaaagtcgaaaacagctggggcgaaaaagtcggaactaagggttatatggtcatgaccgacgagtggatgagcgaatattgctaccaagtcgttgtggataaacagttcttaacagaagaccaacgtaaggcacaagcagaggaaccaactcaattattgccatgggatccaatgggtgcattggcatataaggattagtgaacgaaacaacacgttaaaatccaaataaataagagcgctgtaagcaggagaattcctgctgtaggggttcttatttatttggacttgtgttgtggagttgtcctaatagtgagtgaaacacggtgtttaatttcgtaattataagtgagatggaggcggggatcgcaatcccgcaggaatcttacttataattatgaaactgctgtgtggaactgtccattagtgaacgaaacaaagcgattagttcgataaaaataggtgaagcgaaagtgaggtgaatttctgactgacagctttacctattttttgttagttctgtattatgtagttttctacctttctaaaccaacatcagataatcaaaaaagacaggcacctctgaaattcagaggtcacccgcccttactaatttagtctaaaacttctttactaataatatttaattcttcatcgaattgataaataatgggttctccattagcgacttcaaccccatcgataccttcgtcactaatttgttccaaatatttaattaaggctcgcaaggtacttccatgagccacaacaagctgatttttaccttctaaaagctttggtgcaatcttatccatccaatacggcagtaaccgattataggccatttcaaggctctcgccccgtggctcaacatcacccaactccacgtagcgacgatctgattcagttgtcgccgctaaaagtggtgggacggctttaaaacttcgtcgccacaaagcaacctgatggacaccatatgtttttcgggtttcgtccttattttgtccacgtaaagccccataatgccgttcatttaaacgccatgttttatgaattggcaaccaattttgatgcatctcatccatcacaatgtctgcagtggtgattgctctttttagcatcgaggtatggacatcctcaaactgaatccccgtttgcaaaataagattaccagcttgatgtgcttcttgcctaccctgttcggtaagtggtacatcactccaacctgtatagacattatcgcggttagctacactttgaccatgtcgcaataagactaaatccgtcatttttaatcctcatcttcaacatttgaattaaagctttcgacttttccaattaagtcatttgaatcagtttgatcttctttttcaggataaactggttgtcccatttcggaacgaattgatttagaacgattaccaataaatgtaatcactgatcccatcaaaataatcacaattccaataatggttggtaatgtaatttgttcactcaaaatcagtgctgccagtacaggtgccagtgctggtttgataaagaatacaagtgaagcagttgaaacatctgatgtctccattgccaagaagtaaaatgcaaatccaccaccagtgacacaaacaccaatgaagaagagcaatggtaagtactgccaactaatattctcgaaaacgggaatattgacaaactgcttaagataactaacttgacccattgaacgaccgatagctgaaacatgtgttaacaagacaatggccaacaactcaactgtcccggttaaaaaggtaaaacaagtcattacgatcccgtttaaatctcgtttttgagaaccataacgggaaatgatactgtataacccaaacgttaatgccgaagtgacccctaaggttagtcccacgacatttgttaaatgtgcagggttaacaataaccaacagtccgattactgaaacaactactgaaattaaattagcacgtcctaaacgttcatgcaagattaaatacgaaaaaattaaggcaaacactggattgcaactaaacaatactgcaactgttgctgccggtgaataaacaattgccaattgatacaatgtcatactaatgatgacacagataaatccagtaatcccgaacaaccttaaatctttccaattcagcttacgttgctgtttttttagagaattcaaagcgattggtagtaaaactaatccacctactgcaaaacgaatcagattcaattgaattggatcaaatgcgccgcccgccatttttaaggcaatctccatcaaactaaacattaaagttgaaaaactaatgtaaccgactgtttttctcaatttctttattatctcccaaatattttaaactaaagttcttttcctactatatctttacaaaatcttaagtaaccaatccagacttaacaaacatcattaataatggaatgacaatcaaactcaaaagtgtggtttccgtaaccatgatggccgcatacttttcatcggcatgatataattttgcaaccactggtgcgtttgtcataactggcattgcagactgtaaaatgaaaacttgtttcattaacactggcacaggcattggcaataccaaaagactcatgagaatgggcgcaaaaataaatcttccagacaaaacccctaaactatcacggttaattttgacgttttgaataccagctcgttgaatcgcaatcccaataaagaacatagatagtgggattgttaatccgccaatgtactggcaatccgttaagataaattgtgggagttggatatgaaaaataaccaacaacacacccaaaataaaaccgagaagcggtggtgaaaagatcttccctaatgtcgtctttaaactgaatttttcagtttccgtaccatcccgttgaatcagccaaacacctaacgtccaaaagattgtggtgtttgccatataataaactaacacatatggtaagctgcggttcccaaaaagtgccatattcacaggtaacccaatgaaaactgtgttagaatttaaaaacattgattcaaatagtcccttatgttgctcttttatttgcatgacccggtacaaaacagcagctaatgcaaataaaattaacattgacaaaaccggaaaacgcaaatctggtagtgtacttagtagcttttttgcagtaaaatcatttgtaatcgtgctaatcatgtaggcaggcaaagcaatttgagtaactaattttgcgatcagttttgaggaactttcatcaaaccactttcgccaagacagaatatatccaacggcaatcatcacaataattatgataacgccttgaatactatgtataaaaattgtgattttatcccttccctagatggtgtatgataagtgcaacaatgattagtatagcatattttcatagcttgttttcataaaaaggccgccaaaatatgatgtaaccacgaggaaaacgttttaatttttaaaattaaataattgaaaagaggttcaccttagtgagtgagaaacacatgaagagctctaaaaaatcgcacaaaaaaatttggtggagtattggcattattgctctgcttttattggccgctggtggtgttaaagcttacaccatgtacacaagtgcccaaaaaacagcaaaacaggcatatcaaaaagtaaaaacaccgaccgttcgaaacgttgcaaaggtaatcaaaaataaggacccacttaacgttttaattttgggaaccgatactggtgcccttggacgaaaaaacaaaggcttgagtgacacaatgattgtggcctcattaaacgctcaaaaaaagacgacctatatgacaagtattccgcgtgatacggaagtcaccattaataacacgactcaaaaaatcaacgctgcgtataatattggcggcgcaacccaatcgattaagacagttcaaaatttacttgatgtgccaatcgatttttatgttgtgatgaatatgggtggtcttaaagaactagttaattcagttggcggtgtagatgtcacaccacctctaacctttaaatatggttcagccaacgtgaaaaaaggtgttaaaactcatctgacaggtaaagaagccctttcttattcaagaatgcgttacgatgatcctaacggtgattacggtcgtcaaaaacgacaacgccaagtcattttggccattgttaaaaaggccctctcaatctcatcagtcactcgtttccaaaagattatgaattctatccaaaagaacatgaaaacgaatctaactttcaacgatatgttggcactgcgtttcgcttacaagaacgcctctcatcatgttaagtctgacacattggaaggaacaagcgaaacaattgacggtttatcttatcaagttgcttccatggccgaacgtcggaaaatttcaaataagattcgaaaagaattagggctgtccaaaactaaaaagctcacagcttcaagctcaagcacagatacaaccagttcatcgactagtgagcagagttctgccagcacatcgactagtactagtactgactcatatggatatagcacctctagcagtgacagttcttatacaggcgccccaactggaccataacgtttaaccaaacaaaaaagagaagcacttcaacttttattgaagtacttctctttttttgcttgaaataagctatatttgcgtaatattttcaaatttcttaaaccgttgcgtctttaactgcaagccattcaatttctctagttcgttcaaagaatttactatagctttatctatcctgtccatcaaagtattcgacggggactccactactatctgatctactaacccgatttcttttaattgctgagcagtcattggcataaactcactggcatcttgtgttttgttccggttttttaaaatggcttgtaccgcttctggtgaagccaccgaaaacaaagcattttccagcattaaaatttgattgacattactaaacgctaacgcacctccactatggccttcacctaaaaataaggcaacgttaggcacgcttaggtgacccatttttaaaataagatctgcaattgcctcactttgtccatgttcttctgaaaatgcactggcatctgcgccaggcatgttgatgagtgaaataacaggccgtttaaacttctccgccgcttcaacgactcgtaatgctttgcggtaaccagtcacacgcacagcgccaccatttaattcgcgccgttgctgaatgttgcttccccgattaattcccaaaacagtcactggttgtttgtgaaagagcccaattccagcagttaatgctggatcatctcccagcaaccgatccccgtgaacttcaaaaaaatctgaaattaattgcctgataacttgccgggccgtcaaacgattgggtgaacgaattaacttaattttttcttctagcgttttagtcatgaacatcatccccactatgtaaacgcaacagcgtaatcaacttagttctcatattctcacgtgctacaacttgatccaccaacccatgggtcagcaaatcttctgccgtttgaaaattctctgcaggcttttcatgggtggtttggccaatgactcttttcccagcaaaaccaatttgagcgtgatcctctgccagaacataatctgctttaaatccaaaacttgcggaaacaccccccatcgttggatcagttaaaacgttaatcacaacatgtttggttgtttccaaatctggccactgatttaagattgtgttcatctgtagtaatgaaaaaatgccttcttgcattcgagctccaccggaagcaacgaaaaaaatcaatggtaattgttgttcaattgcaatttgcatgatttgtttaatggcactacctaccgttgtgttcaaagttcccatcatgaagtgactgtccatcacacccattgctactggaaagccaacaatattggcgatcccaattttaatagcctcttcgtcatcagttgtagtttttgctctttttaatttttccgaataacctggaaagttcaaaagattagttgtctgaaacttcaaatcaattttttgccaactcccagcatctactgtgatttttaatcgttggtcagctgttaatcgttgcaggacaccacaaaatggacaccgaaaatccggtgcccactgtaaatcatgcacatgtttcccacaatgttgacaaacttgccaactatttttttcaggcatatgactcatgatttgattcctccatcagcttacctactgaatgaatatcgtactgatccgtaacaaatttttgactggccaccacgcgttttaattcagttaaatttgttccaataccacaaacttccacttgggataaagccttttgcatttgtcgaatcgcctgatcccgatccggagcataaacaataatttttgccaacaagcgatcataaaacggggtgactttatcaccactctgcaaaccagtatccacacgaactcccgttggcattaaaaatgtttgcaactttcccgtctcaaagacaaaatttgtcaaatcgttttctgcgtttaatcggcattcaatggcatgaccatcaaaagttacataggaaaatcctaaagaattatgtgccgcagcttttatttgggcttgaacaatatcaacaccactggtttcttcagtgatactatgttccacttgtaagcgggtattcatctccagaaaataaaactggtgttgaaccaacaaaaattcgactgtgccaagactttgataattggcatcatccaataactggtggaccagtttgtaaagttcttggcgctctggttttgtcagtacactagcattactttcttcaataattttttggcgatgacgttgtaaactgcaatcccgatcacctaaaattaagagtttatccggtagtcctaacacttgaacttcaatatgacgagcatcttcaaaatccctttccaaataaatcgacccgtctaaaaaggaggaatctgcctcttctttcacaatttgatatttagcaaacaactctttggcagaatgtgccatgcgaattcccttaccacccccgccatgactagctttcaataatattggataccctagcttgtttgcttgatcatacaactgagtctcactagtaatcatgcctgagcctggaataatgggcaatccccgctgtttagcaattcttcgtgaatttgttttgtctgaaaaatcatgaataagactagcttggggaccaatccacgtcataccacattcttcacacatttgtgcaaacagctcatcttcagataaaaaaccatatcctggatgaactgcatccgcatttgtattgattccggccattagaattgcttctcgattaagataggaattttttgcactagctgggccaatgcagacagattcatcagcaagccttacaaattgtgcttgtcgatcggctgttgaatatacagccacagctacgatattcaattgatggcatgctttaatgatacgcacggcaatttcgccacgattcgcaatcaatacttttttaaacataattacttatccttttttattgataataatggctggtcaaactcaactgaatcaccatcttgaacccttacgtcatcaattagaccaccacgcggactagtgacatcattaaataatttcatactttcaatttgagcgacgacatcaccggcactcactttctggccatttttcaaaggtgtttcgaagtgcacaattcccaccatgggacttttaatgacaaactcatcagaagttacatccctttgactttgctctggtttaactgaaaccatttgtttagttgtggcatcaaaccccttttttacatgaattttagtttggtcaatttcaagttctacctcactaaaattcatttgttctaatttatctaataatttattgagatcttctaacttcaattctgataacctcctagaagctaatcaacatgctcgcataatcgagaccagccccaaatccagttaataaaaccttttttgaccgttttggatcacgttttaattgatctaaggccattggtattccagctgatgaggtattgccatactccgtgacattgaccggaaacttagacattgaaattgccaatacatcgctaattttttcgataatccgaagattggcttgatgacaaataaccgcgtcaattgtatctgcgtttaactgattcttactcaaaatttgtttcatttgcgtcggcacagtttcagtcgcaaatgaaaatacggaccgcccatcttgatagaaggcatctagttttggatagttagttgctgctatttcttgaatgggagcaattctgccactgtgaatggtttgatgttggcttccaacactctgcaatttttcatcaacaaaaaattcttcttcagggttttccgtcacttctaaaagtgcgccaccagcgccatccccaaagaagactgcggaagttcgatctgtgaaatccatcatcttagaattggtttcgccacttataacgagtgcattgtggtaccggccagatcttaagaacttttcggctgtacttaatccaaatacaaaaccagcacaagctgctgaaatatccattgcaaacgcattgttagctccaagcttatcctgaacaatacaagctgttgctggcgttaaactatcaggtgtgattgttgaaaccaaaatcaagtcaatgtctgttgctttcaacccactcttatttaaaagttggtttcccacctgcacacataaatcagatgtgttctcattatgcatggcaaagtggcgcgtttgaattcctgtatgcatctgaatccattcatcgctagtatccataattttgcttaattcaaaattatcgacaattcgttcaggaacgtaatgccccgttgctgcaatcttaacatgtaccgtcattctttcattcctcacttaacctattttctttattttaccaatctttttggggattggggaatttaaagaaattctcatgtaaatctttataataaattagcttttcagcaaaaaaagactgtctcagtaagtcactccctcactgacacaatcttcatcactacaacttgtttttttcaagcattggcaagatatctttctttccatcactcggtactttttgagcaaacacatttaatcccaactcagtcaaggaacgaatggcatctgcttctttttcaccgactgcaatcgtatcatttagcatggtcatgccttcagaaaatgctaaactgcccacatcgatacccaacgcatgcaaatcaacaccacccttaactaaacgcagcatatcttgcattgtttccgtcaacagtagaaccttaaatgaatcaaacattggctcttggtagagacgcaacattttttcaatggtgatcacatttgtaggaactcccattggcgccgcctgtgtaattaacgtctttcggagctcgtcatttgccactgtgtcagaaaccactaaaatgcgattaggatgcacacttttagtccatgaggtagcaacttgtccatgtaacagccggctatccactcgcgctaataatatttccattggcattatttatcgccatcttgaatttctaaatgacgaacccctgctttagcagttttttccaagtgattgacaacagtgtcaattgattgatcacgaacagtgtatgcttcaactaacattggtaaattcagacccgcaatcaaggtcattcggcctgcattttccgccacaatctgtgtggccacattaaatggtgtcccaccatataaatcaactaaaaatacaatctgatcttccgaagaaaaatcagccacactttttttgtactgtgcttctaattcttccggatcttcatttggctgaaaattaattgcctgaacctcttcttgttttccaaaaatcataaatgaagaattcatgatactttcagcaaaatcgccatgtcctgcaataatatatgcaatcataaaaataagtccccttttatttaatcaaacacattttgaatgatgtggtctacttaacctctacctgcgactttttcttgtaaagagtcgtttaatgatatcccacatacccaaagaacgcacaatatgactgggatcaatatacttacgaatagcacgtaaaacctttttgggatcctttgcggaaaatgaataggttccgtttttctttgttttaatggcaaatcttggaatccatttacccttaaaaataaccgaaacgatgacgtaatccacttcggcccacggaacttgaacaaatttccgaacatcgcgatcattaaagaattcaaatccgtgattaccaatcataattttcccgtaatcggtcatccccaaaaatgaggttccttccataactaaatcaacttttgtattaattgattgtggcatttaaatttactccatttcttcctcttaatgaccataattataaggcgttttgctaatttacgcaaaacaatcaattaacgatcaaaaaacttaaattaaaaaaataagtaaaatcatttctgactttacttattcaagatcttcattcatattctgaatgttaatcatcaggttatatctgttaaactaatttaattttacattaaaccaataacatggaatacaacaccgacaacgaataatccaagaataacaaccaatggagaaactttcttctttaataaccacatacataagaatgttagcaaaactgcggctaatcctggaatcaaaagatccaagttatcttgcaaagtagtcactttatcaattgttaaggaccgaccagcggcttgttgaatcaaagcttctttgactccagcaaatccagatggaagatgactccagtcaatataagcacctttagcctgtttaactgttgagacaacgggcgtgaacttaaccacaacccaccggttaattaaggcaccaatgataaacataccaacaatggaagctactttggtaacattttgtaaaagaccaccagataaatctttagtgatttcactacctgcacgataaccaaactcttgtgtgtaccacatgaagcccatacgaatgacgttccatgcaacgaaatacaagataggtcccataatattgccacccattgcaagtgaagctgcaacggcaccaataattggttttacagtgtaccagaacacaggatctccgataccagcaaggggtcccatcataccaactttaacgttttgaatggttgcatcatcaattggtgcaccatttgcacgatcctcttcaagagccatcgtaacaccgatgattggtgaagctaaatatggatgagtgttaaagaatactaaatgacgttttaatgctgctgaacgttcttcttttgttttatataagcgcttgatcattgggattagtgagtaacaccaaccaccattttgcatacgttcatagttccaagaaccttgaatgaaggtctgacgcaaccagatcgaaatgtgatctctacgtgttaattttaattgtttattatcagccattttgtgttatcctccttttccctaatagtgatctatgatatcgccgactggatcaccagtgtttgaaccaccgccgttattgttagaaccaccttgttgagaaagtgataagtagataagagcaagtgacaaaccaatagcaccaagagcaacaagagttaattcactaatggttgctaaaacaaatccaatggcaaagaatggccatacttcacgagttgcaatcatgttgataaccatagcataacctacggcaacaaccataccaccaccaattgccaaaccatctgtcaaccaacttggcattgcatctagcattcctttaacgggaccagcaccaacggctaagattaaagctgcaggaattgcaatacgcacaccttgcatacatacagcgaataattgccatccttcaacaccgcgaatacttccgcgttctgcagcagcatccatcaaatgaacgacagcagttgcaatggtacgcacgataattgttaataataagccggcaactgaaagtggaatagcaatagcaatagcagatggaactccggctctgccttggccaccaagaactaaaataattgcagaagcaacagatgctaaagcagcatcaggcgcaacagcagcaccgatatttgcccaacctaaagcgatcatttcaagtgatccacctaagatcatgcatggaactaagttacctgttactaaaccaattaaggtacatgcaataactggttgatgaaaatgaaattcatccaaaattccttccataccagctagaaatgatacaaaaatcactaatatcacttgaatagcatttaatgtcatgattattcctccgttttttcttgaatattaagctttcttctgtttgtttaactcactttgtgctttttgaagaatatcttccatgttaccctttgaatcagttgggactttacgaacatcgaagtcgacgccgtcttttttcaacttagcaaaggtatcaatatcattttgatcaaaagccaaaactgtatttggttgaactttaccaactgaatgtgacattgaaccaatattcaatgtcttcaaaggtacgccaccctcaattgctctaagggcatcttgaggtgtttcaaaaagtaacaaggcacgttggccaccaaaatgtttgtcatcttttgccaatttaatcatttgatcaattggcacaacatgagctttaacaccagatggtgcagcctgttggatcatactcttacgcaaatcatcgtgggcaacgttatccgaaacgacgataattcgagtagggttggtagtctttgtccaagctgttgcgacctgaccatgtaacaaacgtgaatcgatacgtgctaaaacgtactcaagtttaccaggtgctcctgcatttgatggttgtgcggaagctgcagcagccttttctttaggctgtaattcttctggacgaactttaacgccttcaacacctgtttcgataatgtgtgctgcaatatcacgggcactatccatagacattcttgaagcatatgcctcaattaacattggtaagttcaatccggcaacaatcgcccatttgtctttgtgagcttcaaacaagttatttacttgattgaaaggtgttccaccccagagatcaactaagaacaatacctcatcttggttttcgaaagaagcaattgcctcttccaattttcctttaatatcatcgggtccttcgctgggttttaatgtaacggccttaacatccttttgttctccgaaaatcattgaaccggattgtaagatcccattggcgaattcaccatgactagcaatgataatccctaccatttttatacctcctattatgattgttacagtaaacaaaaatataacgaataatttcttaataacctgtaactaaatttatctgttggacagacattgacacttaagtacaagaccatcattatttgcactcacttatatataagcaaaaaccgtgccaagatacactagatgaaaacgcctactttaaagcaattaaaaataacacacaagattgatacactacttatgtatcaatcttgtgtgttatttagtccgttaaccatctattttcgggctagcgttgcatttccagaaacaggctgatccggattttcttccttagtctgccaagtttctagaagtttaacaatgtagtaaacttcctcaactggtaaatcaatccgaattctccgaagatggctctcattaacggcttcaaccgctggataccattcagatttactcaatttttccaattctgcttttggcgcggaaatttcccctttggtaacggttcgttcaatcgcaccagcgatatgcatgatcagattgattttaaaagattcgttaaatttcttttgtgtgtcactttgtagctgatcaatgtattgccacagaacatccgtaattttgtggggattaataaaagtataaaattcgtccaaatattgccaacaaagttctttagtcaactttacgtcttgatgatcttcaattgattgaattgagtcccgttcaaccactttattaatgaaggccttaccgccaccttgaagaactttttgtaatggcataaatggtacctgaatattaggatgggtaataccagtggttgcaatcacctgatacttagcttggatttttttcagatgatgatccattccaaccaacgaaattgggatcaccttaatatcatcaatcaaattttcaaccaataattgatctaaaatgtttttgatcttttttgctgtcccttcaccagttgaacaaattgccacaattgctttaggttgcatagttcccggcacaggtttttccgataaatcaacgtgtttttctttctgttctgtagaaacattaatccgtgagtaaccatgaaattcacgcaactctgaataaatcgccgccaaatcggtatcaataaaggatgccttgcgcgcagcttccaagaccatggctgtggtcaccatatcaatcactttgactggaatatgggtttcatcggtaatcttatttccaaacgtgcttagcgaacccatatcaactaaaagcaacacaccgttaccctcatctgctcgtttgacacagtccacaatttctttataggctgtttggggctccatatctaatggcatatcgaatgattgaacggagttatccgataataattgggaaacaacctgaaccatggaagtcgccgtgctgcttccatgtgctgcaacgacaatgcccaccttaccagaagttggtgcaatttttaaagataccaatagaattgccaaataataactttccgactctggaattgggacattgtaccgattttctaactgcgttttaatttcttgagctactttcatttcatttggataatcctccaccatcgcgaccaaatctttactcatggtccgcatcggcttcccagactgaatccgtttaatgaaggaactaatatgcaagctcatggcataaaggaaattatcgcgaaaacgatagttcaattccttttcaatcttagtctggatctcttttgtgaagtcaatgatattttggtccacaatttcggccaatttagcttctgcccgcatatcatcttcatccggtgaaaatgtttttaaatgaagattaatatccgttttaataaaatgattaatgtgatcctgatctaagccttgctgccgcagtaatgtggctttatctccaataatttcatataaattatacggtaattcataactatcgttccggttggtcaaaacgtgtgtatcagaatccggttgaatcgtcatgtaaggttccaataatttagaaatctcaccagagtcacgacgattagcagctaaatgaactaaaccgtccttaatattcggtggtaaatcgtccaccgaaatcatgatttcacccttattctcaatattattcaaaaatccacgcgcacaaaccaactgaatattagactttaactgacccacgtttccataagtgacactgcccaacaaggactgtacaacatcttccgttaaagtaatttgtttgtgtgtccgattggcttcaatacttaataaagccttcaaaagttcaattcgttcctttgcacttcgcttgttaaatgctggtaactgaattgtaatcggaattcgacgaacaaacgtctttagaagcgagctttcaggatcttcagttgtggcacaaactaaccgcacatttgcatgatgtatctttgaagtttcgccaagtttgctgtaggttccgtgatccatgaaataaaaaatcatttcttgaccttcaggtggcaaccggtgaacttcatctaagaaaagcatcccgttatctgcctcttgaatcaagccgtctttatcttcattagcgccggtaaacgcgcccttcacataaccgaataaatgcgacattaataactctggattatgtgaatagtcagcacagttaaacgtaattaactcatctgtttttttaatcagctgctgttgtttggcaaattcaaacatagcattcgcaaaataagttttcccagaaccggttggaccaatcactaatgtattcaaaccacgcggggggtataaaatggctgccttagcctgctcaatttggttgtgcatactggaactgttgccaatcatgtgttcaaacacatcgctaatttcattaatggggtgtattgtttgctctgaaatttcacgcttttcaaggccactatgaatgcgccgttttccttctgccaaaggagaggttacaacttctttgaccccagcttgattttcttccactaaacgacagtatcgtactggtcgtccagaaatcttggtcagtttgttttcacgaaccagctgatttaattccttgctcacattagaacgaattaaatccaacgcattggcaacttcctcagttgttacagcggcaccctcgctcaattctgttaccgtactaccagttgttttttctgaaacaaattcataaattcgatcttttcttttcatatgatgaccctcatcttttgatactgtgttgatacacttgcacaagacagtatcagtttagcatactgtgtcaattaatacagaaattaaccttttcaagatttataacgcttacttaaccaatcttacgacacaaagttaatttttaaattttgtgtattcctatttttggcgagaaaaaaagtaaggaataaattccttacctttttaaaacctattatgcacccaagaagattcgaacttccaccgggagaactcccgacaagatccttaatcttgcgcgtctgccaattccgccatgggtgcaacaaaactattacctaaactatattagcaaaaaacggtaatagttacaacctttttccttaaaatcacgttaacttgcttgaacaagttgcaatctacccccacattttccacaccgatattttttcaaatcaatgtgtcgttgacgcggataacgaagaccacattgctgacaaacataaatcaatcggactttctttcggctttttacagggcttgctggagcgaaacgcgagccaccgacctgccgcaataagtgcctaaacgtagcatcccgatgctgatagccttgatgcgtcaggtgcaaatgatagtggcacaattcatgttttataatgccaattaaagtcggtaaatcatgttctgataacatccgaggattaatatcaatgttgtgggtctgtaactgataacgaccacctgtagtgcgcaaacgtgaattaaagtaggcttcatgcgtaaattttcggtgaaaatcagtttctgaaacttcttccactaatttttgtaattcataatctgtcatttacttgttgcgtcagccggatctaacatggtgagttgaattcgatgtcggtctaaatcaacactttcaacccaaacggtgacgacatcaccaactgaaacagcttcacctggattcttaataaatttcttggttaacttagatacatgaactagcccatcttgtttaaccccgatatcgacaaaggccccaaaatcaaccacatttcgaaccgtcccttgcagtttcatccctacctttaaatcctctaaagtaagcacgtcgcttctcaacagcggagcaggcataccatcgcgcaagtcgcgccctggtttttctaatccggcaataatatcttgaagggtttcgacaccaatctctaagtcagctgctgtttggttaagatctaactgtttaaatgcttgtgcagcttctggagtcccaatctgatccaaacttaacccaacttcagttaataactttttagcagccttgtagctttctggatgaatgtctgtattatcaagcgcatttttcccctgaacaattcttaagaaaccaactgattgttcataagctttcggtcccaaacgagggactttctttaattgatttcgagcttcataactgccgttttcatcacgccagttcacaatattttgggcagttgttttggtcaaaccagaaatgtgttccaacaattgaggactggctgtgtttaagttgacccccacttggttgacggccgtttcaatcactgtatctaattgactagttaattctttttgaggcacgtcatgttgatactgaccaaccccaactgccttagggtcaattttaattaattccgcaagaggatcctgaagacgccgcccgatactaatggcgcttcgttcctcaacatgtaattcaggaaaggcatcccgagcagccttacttgctgaataaactgatgctccagcttcgtttacaatcacataataaatcttccgatcaatcgtttttaatactgacgaaacgaattcttcagattcacgactagctgttccgtttccaatggcaatcatctcaacgtggtagtcttccaaaaattgtttgaattctccagcagccgcctgccgtttagtttgtgaagcaggtttatgcggataaatcacttttttcgctaagaacttcccgttaggatccatgatagctaacttacagcctgttcggtaagcaggatcaaatcccaaaaccacttttcctttaattggtgcttgcatcaacaaatggtacaagttctcgccaaacacgttgattgcctgtgtattagcttcttcacttaattcatttcggagttcacgctctattgcggggccgataaaccgcttgtaagcatcctcataagcatcttgaagttgcgtcactgccggcccttcatgaccgccaataatccgaaaatgtaaataccgcatgatagcggcttcatcaactttaatttgggcttttaaaacgccctctttttcgcctcggttaatggctaaaacacggtgtgacaccatattagaaagagattcatcaaattcataataaagttgataaacgccttcttcatctttttcttttcccttagatttcacttgagaaacaaagcggccatttttacgggtgtaatttcgaatccaatctcggaatccagcactatcaccaaaagcttccgctaaaatttcatgggcaccggaaaaaacatcttcaacagttgtgacctttttgtcggcattaatgaattcactggccttagctgtcaaatcactctgaggaaaggtcatcagccaaaaagcaaatggttcaagtcctttctccttggcaatcgtcgcttttgtccggcgcttttgcttgtatggtaaatacagatcttccaccgtttgtaatttatctgctgatttaatttgcttttctaaatctggtgtcaatttaccctgttcagaaatgagttttaaaacatcatcccttcgtttttctagcgtttctgctttattatagcttgtctgaatttgacgaatctggacttcatctaaactgcccgttcgctcttttcgatagcgcgcaataaaaggaactgtatcgccctcatccaaaagattcaatgctgcatgaatctgttttggccgcatatctgatagttgtttttcaacaatttttacaattcgatcttccaaaaaattcactccaaactaatcatttcgttctcaacaacacatagtaataagtatagcatacaggcccattcattctattttccattttcactatacaaaaaaactaggaatttatttttcctagtttttgttggttattttagcccatcatcattgccataatacgatcaaaggcttttgaaacggcatccatatccttatcctgagcctgttctgctttactaaactgctcagaatcaatctttttatttgcttcatcaatgctagttagcattaattcacaatcctgggcatacgtctcataagcactagttaactgcttatggcgtcctaaaatttgaactggtggttttgctttttttaaagtttcgacattttgcttatacagatcaactgcttttttgaaaatggtgacaatctcatgtaggtcacgatcacttaaagaatcaattccctttaaagctaatgttttcttgaaatcttgaaaatgaggatcaacctcttcacccatttgttcagacgattccattacccgattgagcaaattagcatacccttgcggattacttttacgcattttaatatctccaattctaattattagcgagctgcaaatcttcgttggaaccatttcacgatttcaacaattacaataattgataatgaagcaccaccaacaattgcccactggtgcagatccaaatgactcacgtggaaaatatcattcaaaccaggaaccactatggtagcggccaacaatataaacgataccacaattgaccaattaaagaatttatttttcaaagtagttgcactaaaaattgagccatgaatggattttgagttaaaggcatggaacaactgaattaaccctaatgttgcaaatgccatggtcaacgcatctgcatgtgcctgagcataagaagcatgcaccggatacaagatggcaagaccataaactgtcaaggtaatcagtccttctaacagtccttgataaatcacattacttgcgaccccaccagacaagaagttgcttgctcttcctcgcggcttttgtttcatcacattcttttctgcgggttccaatcccaacgcaattgctgggaaggtatcagttactaaattaatccataaaatgtgaactggcgcaagaatttgccaacccatcattgtcatgacaaacaacgtcaaaacttcacccaagtttgcagacaagagatactgaattgctttttgaatattggcaaacacttttcgtccttcttcaactgccaccacaattgttgagaagttgtcatctgccaaaatcatatcactggcaccttttgaaacttcggtacctgttatccccatggcaaccccaatatcagcctgcttaagggaaggcgcatcattcacaccatctccggtcatcgccacaactttgccttgtttttgccaagcatttacaattcgtactttgtgttcaggggccacacgcgcataaaccgaatactggttaacttttttagcaaaggttttatcatccatttcatccaattcagttccagatataactgcttgatcatcgccttcttcaataatacccaaacgtttggcaattgccgccgcagtatcgcgatgatcacctgtaatcattaatgggcgaattccagcctgtttagcttcttccacagcctgtgctacttcaggacgttcgggatcaatcatcccgattaggccagcaaaaattaattcttgttcgaccacttcagacgccaaggttgctgggatttcatccacaatttgatatgcaaatcccagcactctaatcgcctgggttgccaatttatggtttgtgtccaaaacaagtttacgctcggcgtcatccattgatttgatttcttcgccctcttcaaacaatgttgttcgttgtagtaattcatctggggcacccttgaccgtttgtaaaaatcgtccatcttccaattgattatatgtggacatcaatttacgttcagaatcaaatgggacttcggcaactcttttttctgagctaattaatttttcgacattttcatgtttatccaaattaaattgaattaaagccgtttcggtaggatcaccaatcaaaccttctttagtttgtttggtatcattatttaacaccattaactcaaacaaatggttgtaaggataatcttttggatcgacatccgcggtgtctttcaattgattattcacaaaaactttttcaacagtcattttgttttgggtcaacgttcccgttttatcagacgcaatgatttgggtcccacccaaagtctcaacggctggtaattttcgaatgattgcatgtcgtttggccattcgttgcgtacctaacgctaaggtaatcgtgacaatggctggtaagccttcaggaatagcagcaacggctaaagaaattgccgtcagcaacatattaattaggctttcgtttccccgaatcatccccaccacgaaaacaatggctgcaatcactaaaattaaaccagttaaaactttactcagctgcgttaaattgtgctgcagcggggttgtcgtttcttcggcattgttgatcatatctgcaatttggccaacttcagtatgcatcccagtaccaacaaccacgccactaccacgaccgtacgtgacattactattcatgaaggccatgttagtttgatcaccgattggcaacttactatcctttaaagctgcaatttgtttttcaactgggacagactcaccagttaaggcggcttcttccatttttaaaccagcagactcaattaaacgcaaatcggcaggaataatatcgccagcttccagcaaaacaatatcgccaggaaccacatcttcgctcttgatagtttctacttttccgtttcgtttaacatgagcttgaggcgcggaaagttcctttaaggccgcaattgcctcttcagcttttgtttcctgaaaaacaccaaaaatcgcattcagcacaaccaccagtaaaatgatgatggcgtcaacgccttcacccacaaacacggatactatggccgccacaatcaatacaatgatcattaaatctttaaactgagcgatgaacttttgtaagagacttgtatttttcttagtctctaactgattagcgccgtgcttggttaaactttcttggacttgtgcatcggtcaatccttctggagaactgccttgagctttcagcacatcttccacgctctggttgtagtaattaacttttgtagctttcatgtgttcctccttatttttcgacacacaggggctttttaaaaaaagagacccgtgcatgtccacactaaaatgcgaacatccacgagtctcactttttcaggcaataccagatttaatcttgttgacgacattgccgcagaaataactgctagttactccctcatgttttgttgttaatttattataactataagcaaacctaatagcaagtgattttgctttttatttttcttggcatctcaatcttctagaatttatcgtaaacagtatatggtaaatgacgtttgtgcgccgttttttgataccaactttcgattttttccgcagccttagtttcgatttcatgcccctctagataattatcaatatcatcgtaagtcacgccaagcgctacttcatcaggcaaggccggacgattatcttccaaatcagccgttggaaccttttcgtataagtgttttggcgcattcaactcttctaaaagtgccttgccttgacgcttatctaaccgccaaattggagtaacatctgcaccaccgtcaccgaacttggtataaaagcccgtcaccgattcagcggcgtgatccgtaccaagcacgatgccattattagcaccagcaattccgtactgagcaatcatgcgttctcgggccttgatatttcccttgttaaaatcactaatcttcaaatcattagcttcaagtgcctgtaccattgcgtcagcagctggtttgatgtcgacccgtttaacttgatcagcttgtatatattcgatcgccgccattgcatccgattcatcagcttgcacgccatatggcaaacggactgcgataaactggtaatcttggtcgccagtttcttcacgcatttcagtaatggccatctgccctagtttaccggttaatgttgagtcctgacccccggaaatgcctagcacaaagcttttgataaaggtgtttttctttagatacgtttttaggaaatcaacactacggcgaatttccgtttttggatcaatttcgggcgccactcttaaatttttgataatctcttgttgtaattttcgcattgttgccatctctcttattcactaaattttaacgaactgacgtattttcgaacaccattaatgctgttcatcttatggtcataacatttctcagataaatcaacgggatagtcttgcggattcaaatcacgtttatattcatcccataaggaatccaacatcttgcgagagtattccttaacatctttcagttctggaagtttataaaccagcttgccatctttaaaaatttcatgtaacagtgggcgtgcattgaaatcactcaccgttttgttaatgtacgtataatttggatggaacatgtaaattgaaggttgcttttgcggatcttcatcccagagggtcacgtaatccccctctgatttaccatctgcatttttagaaattcgccaaacttgttttttaccgggggtagaaactttttccacattgttagatagtttaatggtatcaaccatcttaccgtcttcaccctcgatagaaaccatcttgtaaacggcccctaaagctggttgatcataagcggtaattaattttgtgccgacaccccaaacatcaattttggcaccctgcatttttaagttttgaattgttttttcatctaaatcatttgaagcataaactttggcattcggaaaaccagcttcgtctaattgctcgcgtacacgctttgataagtaagccatatcaccactatcaattcgaacgcccaagaaattaatcttatcacccatttctttggctaccctaatcgcattgggtaccccacttttgagcgtgtcataggtatctaccaaaaacacgcaatcatgatgggtttgggcatatgctttaaaagcatcataatcgttacgatagtactgaaccagggcatgcgcatgggttccgctgatcggaattccaaaaattttacctgcccggacattacttgtggcatcaaaaccgccgatgtaagccgccctagtcccccaaattgcggcactcatttcttgagcacggcgcgtaccaaactctaacaaggcatcgttgccaacgacggatttaattcgtgacgctttagtggctatcaaagtttgatagttcacaacatttaaaatggcggtttcaactaattggcaatcagctaacggaccttccacttgcataattggttcgccgttgaaaactaaatcaccttcaacatcggaacgaattgtgccactaaatttaaagttacgcaaatattccaagaagtcatccggataatgttctgattctttcaaataggccaaatcagaatccgtaaagtgcaactgttggatatacttcacgactctttccaaaccagcaaaaatcgcgtacccatttttaaaaggcatatctcgaaagaaaacttcaaaaacagcgttcttattgtgaattccttgttcccagtaagtttgaatcatgttaatttgataggcatccgtatgtaacgttaaactgtcatccggatattttttagtcatgacgattgtactcctcagttagttagtggtttaataatattaacaatagttgcacctattttatcattttttccatggtgcgtcattttcaatagtcgaaaggattgattttattatgaatgacccatttcgaagcgttaaaattatggggattccatttgcaaataccacacgtaatcagtttatcaatcaactccaaactcgaattcaaaatcaccaaaatacgtttgttgtcacggcaaatccggaaattgtcatgtatgcaaaccgaaatgaaccctatcgtaaccttatcttaaaagctgactatatctcaccggatggaattggcattattaaagccacagcaacgctaaaaacaccgttacctgagcgaatcacgggatttgatatttttacaggtctccttaaatgggccgatcaaacacaaaagaaagtgtattttttaggagctaaacctcatgtgatcaaccttttaacaaccaaattagctgctaactttcccggcgttcaagttgtcggtgcccgcgatggttactataaagacgaatcattaattgcggctaagattaaagcccaacaacccgatattgtcttcgttgcaactggttttcccaagcaagagcagtttattgcgagtcatcgtcacctcacaaacgggttatggatgggcgtgggtggcagttttgatgtctttgtagggattgttaaacgagcacctcaattttggcaaaatcatcatttagaatggttttaccgattaattaccgaacccaaacggctcaaacgacaaatgataattcctcaattcatgtggaaaattcatcaactcaaaaaacaaaataagctctgatactaaaaatagtttgtcattttcatttcgaaaatcgacaaactattttttgtgtttttaacgattgagataaaattcaaatcgttcgcccacatattgagtgcgcacatattcaaatggtttcccatcttgtaaatacgacacctgacgtaaacgtaaaattgcttctccacgttttacagatagatattcggcaatcttttcagaagctagcattgccgaaacggtctgagttgccctaccgggaactaatcccgcctttttctctaacgtaccatacaatgaactggttacttcagccttactgaaatctttcacgagattttctggtaccgtagccgtctcaaaacagataggcactttatccgcataccgaattcgttccatccgcaaaactaattcaccatcatttagctctaacttttcgctttcactcatagaaggttgccccgcatggtacgaaatcgttttgctggaaggagttttaccttgcgcaatcattaagtcagtgaaactggtcacaccagacattttttcttgaactttctgattagctacaaaagtacccgaacccacacgacgctccaaaataccctcatcaactaatgtctgaatggcttgtctaagtgtcattcggcttacattgaactgttctgctaattcacgttctgctggaatacggtcaccaactgcccatttaccagcctcgatagattttttaatttcattgtgaatttgaatataaatgggggatcccatgattccacctcctgtaaacgactataagcttattataacgaaaaaatagctagtttcggaactttatttttcagtatttgagaattcacggccatagctgtaagtagccaacttgttcaggttatcatcaaacaagttcaaatccgcatctttacccacttcaagagttcccttactgtccaaaccaaattcgttagcctggttgacagaactcatctgtacggcatcttcaatactgcatcccataaatttcatggcattcttgaaggcatctgtatattccaaaactgaaccagctaaggttccgtcagctaagcgagcctgcttgtctttaacataaactttttggccacctaattcactttcaccttcaggcattcctttagaacgcatcgagtcagttaccaattcgatccgttctgggcctttaacttcgtatgccaaacgcaacatgtcaggaacaatatggaaaccgtcacaaattaattcagcatagatgttgtcttccaacattacgtggccggtaacgcctggttcacgatgcttccattcccgttgtgcattgtacaaatgagttccgtgactcactttactatttaataaatccgcccgtttggcattactatggccaacagatggcacaattccatgtgctaaacagtaagattcaaattcatcggcacccttatcttcaggagccatggtgattaatttaactaacccattagcagacttgttccactgttccaacaagtgaacgtcaggatctttaatgtattgttctggttgtgcacctttgaaagtagctgaaataaagggcccttccaaatgtacccctttaatgacgggattgacagcagctgctctagctactcctttcatcgcatgatcaatgttttcgttcgattgcgtcattgtggtacagaagtaagtggtaattccttctgtttttgtcattttcgtaaccatttcgttaatttggtcagcgtcaccatccatggcatcaaacccatagccgccatgactgtgcacatcaataaatcctggggtcacaattgtttctgcagcaaagtgaatttcgtcatctggcaagggacggaactcgctcattggcccaacagcttcgatttgtttgttaaaccgaataaagccgtcatcaattttctctaaaccagtataaatcgtggcgtgtttcaatacagtactcattagttaaaaatctccttcagttttatttaagttcattataatcggtatagaccacaactgcaaggagaatctgttattcacctttttctttcgcaatggtggcatcaatgcctttgactaccgaggtcataaaaccggcctcttccattgctagaaaaccggcgaccgttgtcccacctggtgaagaaaccttatcaattaaagcagctgggttatcatcggcctcaagaaccattttggcactcccattcacaacttgggccgcaattttggttgctgcctgcttagtcaacccatacttaacgcccgctcgtgataacgcatcaatgaaaaagtaagcatacgccggcgcactacctgcaatcgctccaaaggttgtgaagtcagattcagatacttccatgaccttcccaactttttcaaaaatatttttaccaatattaaatggtgaatctgttagtgggccacttgcagccaaggcggtcatcccttcattaatttcaacattaacgtttggcatcacccgcataattggccaatcaccaataatggcctgcatttcggcaatctctagaccagaaacgacggaagccactaatttgtcagcactgttcacttccaatttaatatcagttaacacctgtttggcaatgtctggtttaacggctaataccaccacatcagcctttttagcaacctcttcattactagtttccagcgccaactgattttgttttgcaaatgcctcataatgttcaaggtgaccactgtgcaccaaaatgtccgttcccgaaactcccgccttgatcaacccaataataatggcctttgccatgttgccaactccaataaatccaattttcatttttattcacttactttctttttttatattcccattttatcatttttcaaaataacaatttgttttcgttgtgaaaacgcttttttacagttaaaattagttaattcttgatttatacctttttttaaacttgatttaatctgttacctatatagtcataaatataaagttaataaaacaaaaagaggagatggccgtatgtgtggattcgcaggctgtttgaccgacctttcaaaaatcgacggtcagactgaaaacaatacagttcatgaaatgacaaatatgttggtccatagaggccctgacgatagtggctactttgaagatgatcacatcaccatgggattccggcgtttaagtatcattgatttggatggcggccatcaacccctatcctatgataatgaacgctactggctaacttttaatggtgaaatttataactttgttgagttacggaatgatttaattaaagacggatacagttttaaaacagagtctgactccgaagttattttagctttgtatgccaaataccaatctgacgtcactaaatatttacgcggcatgttttcgtttgtgatttgggataaacaagaaaagactttctttgctgctcgcgaccaatttggtattaaaccattttactatgccatccaaggcgaccagttatattatgctttcgaaagtaaagccatttacaaaattcttgcgcagcgaacttttgatcatgatgccttgcaagattacatgacattccaatttgtaccagaaccagaaaccctaactaaagaaatcaagctactttcaccaggatgtacattaaccaaaaaaattggtgatgatctcgtaattaatcgttactaccatcgagaatttcatacttcgagcgaaccggaaacggcctacatcaaaaagattcgcgaagttttgttagattccgtcaaattgcatatgcgctctgacgtgccagttggttccttcttatctggcggaattgattcatcaattattgtggccatggcaaaaaattttaaccccaacctagaaacgatttcagttggattcgaacgcgaaggctacagtgaactagatgttgcccaagaaacggctgaaaaattagacgttaaaaattacagcagtttaattacccctgaagcattcatggaagcttttcctaagtttgtttggagtatggatgatccccttgcggatccggctgctgtgccccaatatttcttggcaaaagaagctgtgaaacatgtaaaagtagccttaacaggtgaaggtgctgatgagttgtttggtggttacactatctatcacgaaccagaatcattaagtgtatttaattacaccaagcccttaaatggcgctttaaatcatattgcccgattaattccgcgtggcgtaaagggtcgctcatttttgttacgtggcaccacaccccttgaaaaacgttatgttggcaatgcctttatatttaatgaaaccgaaaaacgtgcattttttaaaaattataatctcagtcatccatttcaatccattacgaaaccattttatgacgaatcacaagattatgacccgattacaagaatgcaatttattgatatgcacacctggttaaacggcgatttgcttcacaatgctgaccgaactaccatggcacacagtttggaattacgaaccccatttgtggatcgagaagttttcaaagtggcttccagtattccagctgatttacgaattagtcatggaacgaccaaatatattttacgaaaggcagttgaaggtattgtacctgatcacgtcttacatcgtaaaaaattaggtttccctgtgccaatccgtttctggctaaaaagtgaaatgtatgattgggcacgcacaattattcaagattcccaaacggatcagtattttgataaaaactactttttaacgttattagatgatcaccgtgatggtgtggcagataattcccgaaaattatggacgattctcacctttatgatgtggcataaaatttatgtggaagagttagaaccgaagaacgatagagagttggtatagataaaatggagattgttattcaaaaattcgggggcacttctgttaaagatgtagccgctagaaagcaagctttagtgcatgtgaaatacgcagttgatcacggtaaaaaagtcgtggttgtggtttccgcctttcgggaaccaggagcatcctacacaacagacggtcttttaaatctggtccacaataaccaatcaaggttatctaaacgtgagttagatatgttggtttccgttggtgaaattgtttccgcaaccgtgtttacagaacaggcccgtgaagctggcttagatgccactgctttaacgggcagtgaggccggaattgtaaccgatgatgaatttcaaaatgccaaaatacttaacgttgacccgactcctatcaaaaaaatgtttaaaaagacgaatgtcgtcgttgttgctgggtttcaaggtgccactaaagatggcgaaatcacaaccatcggccgtggcggttctgatgtctcggctgccgttttgggtatggccttaaacgctgaattggtagatatttttaccgacgtaagcggcatcatgacggcggatcctcaacttgtaaaaagggcccgttgtctcaagtccatcagctatgatgaacttgccaatttggcccataatggcgctcgtgtcatccatccacgagctgttgaagttgctaaacaagctaacttatcaatgcggattcgggcaacctatcaacaacctgaagaattaggcacaattgttggcgaaagaaatccccgcatttctcattatcgaactgttacatgtataaccaaccaaaacaacttaactcaattttctgtttcaactgagaacctaacatctggtcagattttccaattaatggccgcacaaaatctcagtattgattttattaatatttctaccgattcggttgttttcaatttgccacaaatggatacctggcttgctgaaaagactttagcaaccgcccatgcaaactatcgaatggtttctgattgcgccaaggttgccattgtaggagccggaattacgggcactccagggatcacggcccggattgtcaacacattagccaagcaccatatcgatattttacaatcaactgatagttatacgaccatttgggttctaattcataaaaccgacctcactgcggctttaaacagtttacacgatgaatttttacaaaaccatcaattcacccttactcaacagtaatgtcagtcagttatctgcctattctaaaaaggagcgttctcaatgaaagttagcaaattaattaatagtttaaaattcaagcaagttcagccaactatcacaactgattttgatgtgacaatgttgactcaggatacccgcgagattcaacctggtgcgatgtttatcgccgtaggtggctatcacattgatggtcatacattggttaaacaagctgttgaaaaaggcgccaaaatcattgtggctcaaaagcggatcaacgttaccgttcctgttgtgtatgtacaaaacactgaacgagccatggcaatccttgccgatgttttttttgaggctcctagccaaaaaatgcatatgattggtgtaactggcaccaatggcaaaacaaccgttacccatttaatcgaccaaatttatcgagatcaaaatcaggcgactggtctgatgggaaccatgtatcgccgcattaaagatgaaacttttccaactgagaataccacaccggatgccatcacaacgcaaaagactttggcacaaatgcgcgaagttggcgtaaaaatcgtttcaatggaagtttcgtcgattgctttagttttgggccgcgtttggggaattgattacgatgttgctgtcttcacaaatctcacgcgtgatcatttagattttcacaaaactatggatgattatattcacgctaaaagtatgttgtttgctcaattaggcaataaatataatgcagacggcactagtaaagtcgccgttttaaataccgatgatcccgttggtcgtgagtttgaacaatataccgctgcccacgtgttgacctatgggctcaataccgatgcgatgattcgtgctcaaaacattcagatttatagtcatggtactgaatttgacttgtccgtatttggtcatctcacccatgtcacaacgaaactgattggccaatttaatgtttacaatccgttggctgcctttgccgcggcttatgcaggcgggctaccagaagcacaaattatcacttcattggaaaaagtttcgggggtaaaaggccgttttcaatccatcccttctcatacaggggtccgggtaattgttgattattcacatacaccagatagtcttttaaatgctttagagaccatccattcctttgctaaaaaagacatttactgtgtgattggttgtggtggcgatcgtgataaaggaaagcgggccaaaatggcaaaaattgccgttgaatacagtacgaagccgatttttaccgcggataatccacgtacagaagacccgcaggctattttaaatgatatgctagccggcgttccaaacgatcaccccgaagtttacattgatcgccgggaggccattacgaaagctgttgaatcggccaagtcgggagacgtcatcctgattgccggaaaaggacacgaagattaccaaattcttggtcgaaccaaacatcattttgacgactgtgaagaagccgccaaagccctggcgttaaaaccagtggctgattaattaaataagatgttaaaaaagtcgcaaatccagttgttcatgggtttgcgacttttatcattgcttacttgggatcttttgacagaaaatcttcttcaattaacttatttggaatctcctgaacttgttggttcaccacaaattttgctgaaacgaaccctccatttggatcaagcgttaatgccacaattccaccactaaatgcaccggaacgactaccagcatcaattaaataacgcggtacatcttgactgtcagcttgcatttttatgaatccggatcgattaaagatctgaactggtgtatgtccagtgacaatcaccttacctaactcatttttatgccatcccgctgattccaatcctgcattgaaataatagtcatttctaatccaaagtaaatcgtctttttcttgtttattaagactcactccccaacgaacaccagcatggactgcaagtattttgccagtttcccaggtaaatggtcgattacttaagaacttcgtgtaaggggccagttttggagcattgagtgccctttgaatcacaggtagcgcgccggagtgaattcctaattttcgccacgtatgagcaccaccattaattcgccacgtttgataactcaaatcatcaccagtagctgtctgtacccaaaaatcatcatggttgccaattaatacaatatcactgtgctgattaacccgattcatcaaaatatctaaaacacctaacggatcaattaattgcgtttcttcatgctttgaaaaatgccgagttgctgtcccatcaatgtaatcacctagaaaaatcaggcgatcctcttccgtattaatggcattcaaaagtacttttaaatcatcactagctgaatgaatgtcaccgataaatgtataattcattagacgcctccgtctattccactactagaaagaaaactcatcaataataaaaaaataagcccacctaatatgaacctattgtaccgtaaatttttgaagataagaggataacctatttttcactaaaactttactacctaagtgcattaatagaagatacaaaaaaagcctctacatcagtacttaaactggtagcgacttagaaaggcgtaactattgggctagatgggatcgaaccatcgcatctcgggatcaaaacccgatgccttaccgcttggctatagcccattcataaaatggaagggagtggattcgaaccaccgaacccgaaggagcggatttacagtccgccgcgtttagccagacttcgctacccttcccttttgaattgcattaaaacttctaacgcatccgactaaaatataataccgaaaatttgaacaaatatcaaggggtttttacaaatttcctcaaattaatttttttaaaggtcaaagaaaaccagtcgtgatcgccattcggcgaggaaagtatcattttgccattccttaattcgttttgtataataacctactgattgattgtagtaagtcgttttttcaaattgctgtggagctggatgaatgtgcatatgaccgaatattaccttattaacttcgaattgttctaacacttgtcctaattttgcactccccatataggcattagccatattccataaatttccttcaggtgcatagcgaatataattacgtcgtggtacaaaatgtgtaaagtacaggacacgtttttgggcctcctgagccgttttaagttgttgagtagtttcatctaaaactagtcccattctttcaccatcggacattggttgcttaatagacccatctatccagtaagcacgcttccaagtttcaaaattagcgatagttttgcccttaacattgtccgcaaaactgtaatcataccacccgttattaccaattacccgccagtcggtctctggcacatcaaaatattggttatgcaaataactattatcaagttggctctctaattcttcgaacgtaacgccatgaaccatatcatggttcccagcaataaactttacaagcgtttgggaacctaattcgttttgtaagttttgcacatacgctagactctttgtaaaatcattaaataaatcaccagcaattaaatacaacccaacgttttgttggcttaaatattctgcttgattttttagtgtttcatcaacatctaagcgatttacgtcaaagtggttgtcacttgttattgcaatcctcatatttgtctcctttcacactgttagttgatcattttacacgcctcacaaaaaattgtcttctaattagaaaaagatcagtcctttaaagaactgatctttatttttaaatttaattgataccgaccatcttggatgaaatccatttagataacaagagcaatagaaggccaaaaacaatgctgacagcgccgacaaccaagaagtaaggaacttctgtcgcgctcgtgtaaaaacgtacaatttgggcattaattgcttgaccagcagcatctgccaagaaccacatactcatcatttgagaactaaatgcttttggtgctagtttagtagttacagaaagaccaattggcgaaattaacatctcaccaatttcaacaattgcccagctaccaactaaccaaaggggattgactttaccagccgttccaaacatcattcctggtaaagcaatgaataagtacgaaactcccgcaaacgccaacccataagcaaacttatgtggagatgtaggttgcttgttccccattttaatccacatccaggcaaagaatggtgtatataacataataaacaacggattaagggactggaattgtgaagccgccaaagtaattggccctaaatgtaactgtgttcgttgagccgcgtataaggcaagaaccactgatccttgttcttcaattgcccagaaaatcactgcggcaataaataacggaacataagcccaaagacgagaacgttcaattttagtcactttgttacttgaaaatatcaaaacaaaataaataattggtgtggcaactgccaccaaacttaataacaagacaacattgtcaattgtcatggcattggccagttgcataacgagcaggataagcgcaaaaataacaaccccaatggtcacctgccatccaagtttatgtgcgtccttaggctcaagtgggtcagaaggatacaaactgtctttgcttaagtactttttcccacctaagtagtattgaagaagaccaaagaacattccaattgcagctagtgaaaaaccaacgtgaaagttcacgtgtgctcctacccagccaacaagcagtggcgcaatcaaggctcctaagttaattccaaaaacaaagatgctaaatcctgaatcacgacgaatatcttcttcggtatataacccgccgaccatttcagaaacattaggctttaataacccagttccgatgacgatcagtgcaattgaaataaatagtgctggggctccaaatggtagtgctagtgcaatatgtcctaacatgatgaaaataccgccccaaaagacagtttttcttggtcctaaaatacgatcactaacaaaaccgccgattacactcgttagataaactaatgaaccatatatggacatcacagaagcagaagttgtctgactaaaaccgagaccaccctttgatactgcatagtacatatagaataacagaatggcacgcattccgtaataactgaaacgttcccacatttctgtaaagaacaatgttgagagccctctaggttgcccaaagaaggacttatcattgctcacgtcactttggttattcaatttatttcttcctccaaacatctctatgtagcttatcgtgtattatttttaggggtaaagcttcccaaattctcctaaaaacaacaaaagacaccataaacggtgtcctattcaatgccggctaggcgacttgaacacccgaccctcggtttacgataccgatgctctaccaactgagctaagccggcaggtatagaaaaagatgctaactttcaattgagaaggttaacatctatcacttcctgcacatttgtttgtcgaaaattttgttcagttttcaaaggtctacatcagaacacaaacatttttggcgaataaattagaattgttcgtttattcaaatccttgtgtcccttgcctctaacagcaagaacaattatataacagccaatctttcaagtcaacaaaaactttttaattagcaattggtatatgtgttcatgtcattgaagcaacgagtaatatattatcagctatttcggccgaggtcaacaggtaatttcaaattaattcaataaatcgttgctgacaaagcttaaagattgttaataccgggaacaaatcctccccgcaaacaccatttagcctgtatactggcaattgaaatcttcgcgaaaggaactgtcatcatttgaagaaaattgtaattatcgatgccaaacgatcagccatcggcaaattaaacggctcattatcttcattaactgccgaacaacttggttcaaaagtcacgcgtgctttattaaaagatgctagtctttccggcagccaagttgatcaagttatctttggcaacgccatccaggccggaaatggccaaaacattgcccgacaaatcgaattgaacagtcaaattccagaaagcaaaacagctttcacagtcaaccaagtctgtggttcaggactgcaagcaatccatcaagcacaatccgccttgcttctcggggaagtggaaacggtcattgccggcggaaccgaaagcatgtccaacgttccttacttgaacatgtcacaacgaaaggcaaccaagtttgggccggtcacattatatgatgggctgcaacgagacggcctaagtgattccgcgacggatgaaccaatgggaatgactgctgaaaacgttgccgatcaatatcatgtctcacgtgaagaacaggatgcttttgcattgcgatcacatcaactggctgcgcgagctactgaacagcattattttgatgatgaaattattcccattgaactcaaccaacccaaatcacacgctccccacatcgtagcgcaagatgaatcgatccgggtcgacacaaatttggaaaaactggccgcccttcgtcccgcttttaaaccgaacggatccgtcactgccggcaacagtgcaccactaaacgacggcgcttctgctctgatcatgatgactgaagaccgggcaaaccagttgggactatctccaatggcagaggtgctgggttacgccgagcgcgggatcaacccggaagtcatggggtatgcgccctacttagccattaatcaattggtctcccagctcaacatgtcagtcaacgacatcgacctctatgaaatcaacgaggcctttgcttctcaatcagtggcagttgttcgtgatctgggcatttcagttgataaagttaacattaacggtggggcaatcgcactgggtcatccgctcggagattctggtgcccgcatcgtgacgacgttattgcataatctgcgccggaccgaccaagaatttggcgttgcctctctttgtatgggcggcgggatgggctccgcactggcaatcaaacttctttaatcacaagaaataggaccgtaggctaaacgctgacaacgtttgacccacgatcctattttattttaattaagttttatctgttcatcttcaggtaagtggtctttaaacgaagattgatacagccaataataaacccgcttggtggcttttgtcatctcagcatacgcaggattgatcgatttaacttccggatagacccgcattaaatgactgaaggcactgaaacttccagcagcagacatcccgtcatcgtccttcttcccccgttcaaccaggccaattaattgatcaacctggaatcgcgccagggcgtccacataatcaaagagggttccggcagcttggaaactcggctcaatcacctgccgtgacgttgtgtactgtccggaggcaatttgggtcaacaactgatttctgctcatcgtatattgcaccatcaatggcgttaaaaaaacattctgtagaatctgatgagtggtttcaaaaatcccataggctaccttgaccgtttcaccgcgatcattcacctgtggccggtcattttccaacacccgactgtatcgcaattgatagttctgatgtttggcatttctggcactgccggcgttacttaaattcaatacagccaacttttctgccagatcagcacctgattggggtaagttcaaatatttcccaattgcctcaactgcggctttggtcttggcaagaaccgttgcctgatcagcggcactggtgatcggagcaccgactaaatcgggattattttgagtgaattttgcgtaaaccaacgcatataaaccgattgatcccagtgaattgaccatgccggccaacgtgttgttgacaaatagattaatatcttctgtcagcgaaactttgccgatcgcatcggtcatcatcttgggtaaatcgtgctcgtcactaaaatcgtcttcattataggaataatttccgagcagcgactgttcatcattaccgactggctggttgcttaaaaagccatcgctaatttccctggcaacgcccgtggcgatcgtctcatcgatggccgatggcttggtcgtttggttattaatcgctttaaatggtgaagcaccgttcatatagccgttgacgtggtcaaaccactgattaaccagggtccgctgttgattgagatccaggttctgcaaggcagagttaatccggaaaacaacgccaccggcgccggcaatcgcccggacaaattgaatcaccgctgtcttataaccaacaacgtacttttcaggagcctggctctgacttaagtattcagaaaattgagtgccggctgcccggttgacgactgaactgtcgtcatctccggtcgcccacagcgacatatagttaaattgatcaatgctgacatgttttaaatccttggcggctgccaaataccccatctgcattggtttggacattttaaactctgccaacgaaacacttggctgcagcggaccgggcaaaaacgaccgcaagccccgggtaattcgttcagaatagattgagctcttagcgtaagtattttctcccagcacttttgaagtcattaaccccaacatgctgagaattttttgttgtttcgaacgggtgtcggaatcatttaccgacgaactggccttattcatgtcgaaaccaccccctagtattatgactataatatcataaactatggcgaatcattgccaacaaatggggaattaaccattctgaaacaattttcaaatctgaggcgttatttttgtgattcattcaaaaagtctgtatgcttatggtagagataaggaaagggtgtgaaactaatgggaaatctgaaaaacaagtccgatgaagtcatcggcaaagtcaaagaaaccgttggcgacgtaaccggaaacgacaagttgaagctgaaaggcaaagctcaaaagacatctgggaaagccaaagataaggttgaagatgccaaggaaaaggcgtccaagaaagtgaatgatgccttggacgacaagaagtaaaatccagctgttaaataagaaacccgatacctgcgaatcgcatggtatcgggtttctttccccaaaaatgagaaagtaaaactttttacatgttttgtattgcatgccaaataatattgttctataattcactctcgtgttattttgatctaatcaattgaattagaaatatgaacagggatgtgaatcgaaatgtcagcaacttatttgcgtcaagcaaccaatgcagaccttccagaaatcaaaaaaattattgaagaagcaaaagcctaccttaaaaagcaaggcatcgaccaatggcaggatggctatccggccaccgaagacttggagtttgatgtcaacaacgggatcacctacgtgttaattattgacggccaaatcgccggaaccgcagctctccaccaaggattggacgtcaactacctcaacattcacgatggcgaatgggtcaacggcgtccacggccgctataccgccattcatcggatcgccatgtcgtcgaatttccgcggccagcacctatcccaaaagatgatcagcggcctaatcaccatttccggtgttctgggttacaaagatatccgaattgacacgcatcccgacaacttgggaatgcagcacgtgatcaccacgaatggttttaccaaacggggcacgatttacatggctgaaaaagacagcgaagcatccccacgctatgcctaccaactggttattgggtaagcgaacaagttggagtacaatatggttaatgaggtgataatatggcacaagatgatgctgccgtaaagaccgcactaatcattatgtacgttatcggcgtagtttgtctgggaatcacattcttcctactcgataaagtcaacggaaaatggtttaccaagttctcagtcggccttgtcggggtgattttagtaatgggaattatcttagtcaatgtgattaatctaaattaaagagtgggacataaggcgttttgatcccagaatttaagcaaataatccggttattcctgtctttggaatagccggattatttgcttaaatggccgggatcagccgactgccgcacgtttaaactagataacagaggaataaaaacaaacgggtgagacaacacaaattgtctcacccgtttgttttatttaaactaaatttgttggaatgcctgatccaaatcagcaatcaagtcgtcagcgtcttccaagccgactgacaggcggatcaattcgtcctgaatacccattttaagccgttctggcttgggaatctcgaagtgtgacatgaatgccggcacttcgaccaaactttcagcagcgcccaaactaacggccagaatgatgagctgaaggctgttgacaaacttggcagcgtccaatccgggttggacttcaaaggagagcaccccaccggcacctttagcttcatcactgatgatttggtaatcctgactggttttgtcaacagttgggtaataaatcttggcgactttgggattactttgcaaataagcgatgattttctcggcgttttgaatgtgccgatccatccggatgtttagggtttgaataccacggcgaagcaagttggcttcttgaggtgccaaaactgcgccaatggtattttgaatcgcataaatttgatcgctcaaatccttggttttggtgacaatcatccccgccgtaaagtcagaatgaccacccaagtatttagttgccgagtgcagcaccacatcggcgcccaagtctaatgggcgttggagataaggtgtcaaaaaggtattgtcgacaaccaccaaggcattgtgttgatgagcaatttgggaaatctgcttgacgcttgaaaccttgagtaacgggttggtcaccggctcgaagtagacgcctttggtattcggcttgaaagccgctgccaccgcatcggcatcttgggtatcaacttcggtgaattccaacccacgtggcttcaaaaaatcattcaccagtcggaaagtcccaccgtaaatgttatcgccgataatcagatgatcgccaggcttaaagagcgccaatgccgcatgaatggccgccatcccgcttgaaaaagcaaagccgcggtcaccgttttccaatttggcacacacgtcttcaacggcatctcgagttgggttgccggaacgttcatagtcccatttaacatccgcccccagcttggggtagcgaaaagttgatgagttgtagatcggcacgttcacagctccggtggagttgtcattgggacggccgccgcgaaccagtaatgtattaaatttaaccattaaaaaatctcctatctctccaaagtggtggtgctactgaacaggaaccaattgatctgatgataacagatacagatatttctttgtaaccggcctgccgagaatttgatccaaagcagtcgcgtacaggcggatctggccgtcataacgttcatgaaccgtatcaacagtggtcttcggggtcagtcggtcagtcttataatcgaacaacacgacgcccgcctccgactccacatagccgtcaataattccgtgaatcaagatcggttgatcatcatcttggtcaaaatccttgaaagcgtttttagccttcattaatagtgaaaacgggacttcgcggtaagttgtctctgggttagccaaaacaaccgcgcccagagatgacgcataaaatctcagaatcccgtcgacgttaatttctccggcaacattctcttctaaaatgccttcctttaccaggttggcgatcaactcaacgatagtggcctttgtcggctgttggtgtaaatcaatctgctgcagtaccaagtgggtcgccgttccaacctcagtaggtgcgggtttatgagttccattttctgaaataaattttggcgtagccagactgggctgcgtataacggccgggtttgatcagctgatcgctgtcaatcagcgaataattgcccagctggacgttatcgggatcatcgaacagccgcttaatttcggaaacggattggtaggctgtcgtgcgagttgctgcctggtgtgggtaacggaaattcatgatggccttaatttgtcggcgatcaacggctgaatcggattcgaccggctgctgctgatcgagccaactacgaggatcaaccgctacacggccagcctgcttctttccttcagccaccttggcattgtcataaaattccaggctcaaccggctggggtcatcggcgagcaggttgacaattcggctgtcgccatagtctttaaccacatccggatgacgggaaattgccggaccaatccagtccaaatagcttttggcgctgttgcgctccgccattggcaataagatggccgattcttcagtctgtgactgccagctttcaacgatcgactgcaaatctaacgttggtttgcgagacccgccttttcctgggtcgactttaccgaccaagaacagccgctgctcggcccgggttaaggcaacgtataacttccgcatttcttcagacaaaccggcatttttggtcacatccaagacggcctggcgttgcaaaggttcttgaatctcccgggttttggtatccaaataagaaatgccaattcccagatgatcattcaacacggcacgtcccatggtgtcctgctggttgaattgtttaccaatatcattcaaaaagacaatcgggaactggaggcccttactgccgtgaatcgtcatcacgtgaaccatgttgtcggaagtgttcggcaccgctgtggctaagtcgtcatccctggcctgcattcgctcgataaacaggacaaatctgaacaaacccttaaacccattcttctcgtaatcaaaggcccgctcatacaaagcatgcaggttcgtctggcgctgatagcccccgggcatcccgccaacataatccaaatagccggtttgattataaatttcccaaatcagggcaaccaagccgtcttgtttggcaacgtttttaaaatgatccagctgcttgaacaaggtgtcgattaacggatagattgcctgagcatatttgttgggttcagcgttgggatagtcccggtaaaatttcaataccgactcataataattccccgtcttttgattaatccgcaaataggccagctgattttcatccaaaccgacgatcggcgaccgcagcacggctaccaaggggatatcttggtaaggattgtcgataatcgacagcagggatagcatcacctgaatttccgtggttttcagataactcttggcaccggtaatttcggccggaatgccataatctttgaaaattgaagacatggtaatctggctgccccgagttggcgaaatgacagcaaagtcaccgtagtcaaccggtcgatcgccatcgccatccgcaatccattccttatcatcgaccatctggcgaatcttttgggcaatgatttcaacctgcccaacgtcagcatccataacttgctcggcaggaaggttctcaccttctgacagcggctttttagggctgtacagcagcaccgaaacgtcagcgtttacgtcttttggataatacttggcgccaaactgcagcttggcatctgaataatcaatttcgccaacttggcggtccatgatctgctcaaagattaagttaatgaaattatcgacgttctcagttgaccggaagttatcggccaaggtgattaattcatcgtcattatcagccagcgaataggtccgctgcttattaatgaacatctggggatcggccagccggaagcgataaatcgactgtttggaatcccccaccatgaatcggtttccgccgccttctttggccagtttattcaaaatggcgtcctgaagccggttattatcctgatattcgtcggtcataatttcataatactgatcccggagctttgcttgaacttggcgggcctgcgggctgtcgtcgttcaaaatccggtaagcagcctgctcaatatcgatgaattccatcaaatggcgctgatgcttggttgcctcgtaagcggttcgaaaggctttgaccgctgaaatcagtttggccacccgttgcttggcggctgccatcaggtcaacgttggcctgttcgtccataccgaaatatttattgcaaaaggcattgaagtcttttttggtttgttgattaattgcgcgaatttggccatgaaactgtttttgttcaccctgcggtttggttagccttggcaaatcggcaaattcaaaaccagtcagtgacttgcggacatcgtcaaatgatgtgcaatttgaaaccgctttttgaagggcttcaatggctgccagctggtcagtgaaagctttttcgtccttatccaaggcaccgctttgggccaatttaatcatgtactgatgattgattttaagtttggtgaatgcttcagcaatctttggggcaacgttttgttgatagaaatcactgtcatacaatggtttgccgccaagatcataaaaatcggtgaccgcattcagccaaccatccggatcgtcggtaacatttgcgaactcgtccaatcggtaaatcaggtcggctaagccgtcgtcactgcggtcgttggaaaagttctccgtcaatcgggcaaatgagccatcttcatcgttgccatataggtcttctcgaaccgctccccaaacttgatcttttagcagctgtttttcagtatcgtcggccaaaatgcggaagttgggatcgattcccaagagatagtagtatctgccgactaatttctgacaataagcgtccatcgtcgtaatgtcggccaccgcgactttttggatttgggtgagcagccggcccttttcggcttcagctgcctgattaaattcttctcggagggctgcctgtagtcgttggcgcatttctttggcagcggcgttggtaaacgtcaccaccaggagttggtcgatgtcgacgtgctgatttttgaccatgtcaataattcgatcgaccaacacccgggtcttcccggatcccgcagaggcggaaaccaggacattgcctgccgggcggtctttaattgcctttagttgatcaggcgtgtattcaaatgccatcggacttttcctcccctaattttttcttaatatcctcaatcgaatcactgttaaccggccgatactggttacccggcaaaattgggtcaaagttcatgattgatttgtacggggtaaactgcatcccggtggtttgaccctgcttaaacggccacagtcgaacgtcaccggcaaaaatcttttctgccgcatcgacaataagtttctcagtgtgggtgagaaacgcatctaactgcagtggattaatcagtgattttttacccgtgtagcctttggcggtctttctaattggataaatcggtgagtagccgctatccagctcctcatccaaatgatcaatcaagccggactcgtcaaccaaaatgccgttatagcgatgcttctttaacaaggcatcgtcaaaggtcaccttttgaaggtcctcgggtttgaagacggcattataaatgtgcaggtacaacgcgccggccaaggcgacttccttatcatcgggattaagccgttccagattgtgctttaacacgtccagatacgtcaacagttgcatcgaagttccgtcataagctgcattgaaatcaaatttgcggtcagaggacttgtagtcaacgattccgaagtagcgtttgtccttggtggtcatcgaatcaattcggtcaattctgccccgcactttaacctgatgatcatcagccaaatcaaagcttagaccattgagggcctgcttttgattgggctggccaaaaatcagttcagtattttgcggccgcattggcgtcagtttctgttggtcacgcaaggctcggatcatctgctggatggttgcggctaactgcatggaaatataatgcatccgattggaactggtcagcacaacgtagtcaaagttttggggatcattgatgattcggtcgacggtttctttgacgaggtcgctcacatcttgatcagataagctggccaaatcaatgttttgggcatgaatctgcttaataatccggtccatggcgtcatgataaaaggtcccagtcgatgccgtcgacagctcaaacttcggtcgttcctggagttttagcccatatttgaggaaatattcataggggttcttatagaaggtttccagctgagaaatcgaaatatttagttctgaaccgtatagatccgtgatgatttcaggtgctaatgactgcggaacatttgtgtaattaatgcttttaagcagcttggacgtctgccggctgacttccggatcctgctgcaggtactgcaaaatcactgcccagccggcactcaagtcctgctgaacatcaaagttattttgaatgacctgaatcaaatggtgaagtgtcccgctcttggtgcccacgtatggcatcacgtcgtgctcatcatcggggatcgccgggttgttgacgattttgaggttaaagaaatgctgaatccgtgaaacataaggtgaaagtttcacagcagattcgtcgtttaatttgttggtgtaggtgaagataagcttgtccgaagcggtcatgaaggccaaatagttcaagtacggttcaaaagccatttggacttcggcgggatcatttaagtactgatcgtcactgaggttgctttggagttggttgatgtcgtcatcgccaaagagattttcattgactagccgatccggcatgttgtcatcgttagcgccgatcatgaacgtgactcgataatcattcatctgaaccatgccgctttcagagacgctcacctgatccagcgtggacggaatttgtgaatagtccgctccttcaaagccggcatagatgagtgaccaaaaatcgccgggcacaaacggtttgtcccccagaatttggacacattcgtccagcagggaacaaaatgtccgccaaacctgctcaatttggttggaacgattgatatcgccctcgtctgttgccgcatcccgccagtcctggagccggtcaacaacgccggcatccactagaaactggtagagaatttgagcagcttcctggttggttttagctttgaaaaattgtttgtaaaaattgggcaataaatctcgcaccatatggcggatgatattgatcttgcgggaaatttcccgatcttggtcggtgatctttgtggtcttctgttcttcgtcgctgtccggcagccaaacgtactgccaatcagccttttgcgtccagcgggtgtcggcgtaatcgtttttcagcaccaagttgtcggtcaaggacactgcttgacgataatcatcaatggccatcggcttgccatcaatcattggtaggactaattcagattttaagaaccgcatcacgtcatcatagcgataattgcgggttcgatttgggtcgtagatatcaaatagcgctgctaatagttccaccagtggatggtcagccattgactgctgaatatccttgaaatagggaatctgctgggtggtaaacaccggctctaaaatattttgataggcgtccaaatggcgggtcaaaataagaaaatccgagtatcggtacttgccggtggcgaccatttgatgaatcttcgtggcaacttggtccagttcggagtaaaggttgtcagcttgataaatttgaaccgagtttggggaaatttggtcgggcagttggtggtttcccagactgctggacgtaatccaataggcctctaatttttgcatatcttcatcaacccgcggctgatcagccatgacggcctttaaataaggcacccggttgtcagcggcaaatcgatagagctgatggaacaatttagccggctgaaagaaaatattcggctgttccggcagttcagttgggtatggccggtccaacgtcaatgacaccgtcaccgaagcggattggttgatcaaggtttgcaccaagccgcattcctgggcggtgaattttgaaaaaccgtcaatatagaagtgataaccacttaaatcaatgtcctgcagtttgctgctcagcaggttcaaaacggtgtggctgtcaaaataattctcagaaatgcgtttgacatactgggaataaataatggcaaaatcgtggagtttatcacgcagatcattagtaatcgtgctgtcaggccgctgcagcatttccaaaagatcttcaggcaagacattgccggcctgcatctcggcaatttgggtagcaatctgatcaataaacccgggattatgaatttcgtggtcaaagagcaccaatcgatcggcgttatcaacaataatttgatacagcagcatattgataccggcactgctgatccgctgcttttgatattccggtgtgttgcgcaaaaagaaccacgctaatcgggtgaaggataacacctgaacatcactttgagcagtggtcatttggttggcgtcgccaagttgttttaaaatactgacttctgattcaaacttaatgtggtttggaaccaagtagaaaaattggtcgtggggattgtctgatttttgctggcgcagaatgtcgatcattttcgattgatggtcgacacctgctcgacctaagacaaactgaagggtcactgctctcacctctttaaaattactttaattttaccatagtatattcctcatgtttgatgaagattgacgatgatttcttaagtggagggaaacgccaatcgcgctcccagcaagggattggttgggtatcaaaatgatttgtgaatttccggaacattatcattgaacattaacaaaaagggtctattatgagggttggatgtatcttacatccatctatttgacctaaatgaaagctttatgcttgcattgatcttgttagagagcctaccagtgcattccacgattaagtatcggaagcaagaatttacgatctacccccaatatatctttcaagttcaaatactgataggccctactcctaataacgcccggtgaaaactgggtgtacataaagaacagagtgcgaaacaagccggttagcttcggagcattaatttgataaccagttttgatgcgtatttcgcatcgaaactggttatcgaattaagcggacgaagctggcttgtgtagcacatttccactaaataagagtaaagctccaaactttgatgcgctctttgcctcaagactcattattagataaagcgaaacaatctggcccgtcggaacacacctttgccaactaacagtcacacaccacaaaccaaaatacatcaaaggaggcagccaacacggttgcctcctttaataatggtatcgatgcaaagaacctaagcccgcaccttattttcttccatcaccttattggtataaaactccaaatcatcgactgcctgatcatcctgatctccctgagccgttacagcgtggagattctgctgggcaaccgcccaataaaccaggttggtggtaatcggcagaatgtcccgaatgacgtgaaagtcgaaattatcgccatttgtggatttcatattcaaaaagttattccagtcggtcaccatattgacgccactgtgttctttcttcgagaccgcagaaatgatgacgaagtgggaattgcgatttgcttcttccaactgattttttagctgttcaatttgttctgcttccagtttaattgccattttatcgccctcccatcggtgtttgatcaataattccaattgaatgattcattaatttttgcttgatcagcatttcataagccagcttagcaaccgcttttggagataccgttttagccggcatcggcgttccttcattaaacagttcatagtcgctggcctgctggtcctttaattgacccattctaattatagaatacgcaatttcggattcgtcgacaatcttgatggcatatctttgctgttttataaattcttgggggtctttcacgccagcataagtgaccgactcactcaactcgtcatcaacaccggcgtatgagagcatcacaatatcactgattggcggctgaacctcatcgaccgcctcaaagagcgcttccacataaaggtcggcgtcgttgggaccaacggcgatgaaaagcaggttggtattcggcaaggcttgagcatagtcacttgctgattccaaattacccgaatagacctcgacagaaatgtcggagcgttgcttaagtaacgcgtttagtggcggcaccacggggctattttgattaatgattaataattttttcaaatcggtggcttcctaatctaaatgtttttcaaattgtgcataatggaccataattaatgtgtaccataataacaatggaaaatcaaaggaggacgtaaaaatgtcccaaaaagttaaaattggtcaatcagacgttgtcagcaccccgttaggctttggaaccaacgctgtcggcggtcacaacctgtttcctaatttggacgaacaggccggcatgaattccgttcgggcggcattggatagtggcatcaccatgctggataccgcatttgcctatggcttcggccgctctgaagaattaatcggcaaggtgcttaaagactatgaccgctcaaaagtcgttgtggctaccaaaggcgcccaaattgtgaacggcgatcaggtcaccatcagtaaccgacccgctgatcttgagaaatttgtgaaggacagcctcaaacggttgaataccgattacctcgacatcttttacattcacttccccgatgatcaaacaccgaaagcagaagccatcggcaagttagccgagctgaaaaagcaaggactcatcaaagcgattggcgtttccaacttctcgctggaacaactcaaagaagctaaccagaatcacgatgttgatattgtggaagaccagtatagcctggttcatcgcgatgccgaaaaagagctgttcccgtatctggagcaagaacagatttcatttgtgccattcttcccgctggcatccggtctgctaactggtaaatacgatggtagtccggttaattttcctgaagatgaccttcgaagcggcgaccccaatttttctggcagccgcttccacgccatcacagagtcagtcaagaacctccaaccaattgcagacaaccacgatgccacgattgcccaggttgtcttagcttggtacatcaagaatcctgacatcagcgtcgtcatccccggtgccaaaacgccagagcaagtccgcagcaatgccaaagcaatgaacgttgccctgtcggatcaggaatacaatacgattgataacgcatttagattctaatccacatctaaacagacatcgaggccaccaatgtttagcgcaaatttctttgcaaaccgcttcaatggtcaggccttgatatagaatttttttaaaatgcatttgtgacccccgcttaacgacaaatggtatactcaagttggatcggagagcgcttacaattaagttatgagggggcctcctttatgaaccgtttagatggaaaagttgcaattattactggtggtgttagtggctttggtttggcagctgccaaattatttgtccaagaaggttccaaggtaaccattaccgatgtcaatgattccaaggctgaacaagctttaaatgaaattggcaaggacaaggcgatttttgttcaacaagatgtttccaaagaagccgactgggatccggttttccaaaagacgattgaccagtttggcccagtcaatgttctgttgaacaacgccggtatcttaatttttgacgatgctgaaaacgtcgacatggatcaatggcacaagattttatcggttgacctggatggtgtcatgcttggagttaagtatggcatcaagtatatgaaggaaaaaggcggatcgatcatcaacctggcatcaattgccagcctgatcgagatcagcaacctttattcctacaatgcagccaaaggtggtgttcgactcatcacgaagtcggctgcgctatacgctgctgagaaggattatccaatccgggttaactcgattcacccagggtatgcccacacaccaatggttgattcctaccctgaactcagacaaaaactcgagagccttcacccgatgaaacgactggcagatccaaaggaaattgccaacatggccttgtatctggcttcggatgaatcatcattctcgactggttccgagttcgtcgttgacggtggttatacagcacaataattcatcatggcttgagaagtcctgactggggcgtgatgattggcactgcttaataatccaactcaaaatattgatttttattaactgctcacgatgaatgtcgcgagcagttttttactaggaaattggtgtaaccagttacataaacattcaggcataacggtaaacattttattgctttttattaatttaattcgtttattgaacccttttaatgataatgctaaaataaatatgtaattttttattcatacacgaacgatagaaggagctattatatgttaaattcaattgccaagtatttcgagtttgatgaacgaaatacgaatttccgtaaagaaattatcgccggaattacgacgtttgtttcaatggtttacatcttgttcgttaaccctaacgttcttggagtcagcgggatggacaaaggggccgtcttcaccgcgactgcccttgcttccgcatttggctgtttcatgatgggcttcattgccaactacccaattgcgatttctgccagtctggggatcaatgccttctttgcctactcagttgtgattggcatgaaggtttcatggcagactgctttagccggggtcttcgttgcctcagttattttcatgattttgaccgctttgaagctgcgtgaaaaaatcatcgattccattccagctgacttgaaagctgccatcggtggtgggattggtttattcattgcctttatcgggctgagcgacggtggcttggtcactgccaacaaagacaccttggtgagcctaggatcgttacacgtcgggacaacttggctgacgatcttcggtctgttaatcaccgtcgttttgatgagcatgcggattccaggtgccatcttcatcggaatggtattaaatgccattcttggaatggtgaccgggttgattccattaccacatcaatgggtttcttcgattcccagcttaaaaccaacttttggtgttgccttgtcacacattggtgatatcaactcggttcagttagtcgtggtcgtcttaacgttcctgctggtaaccttctttgataccgccggtacgttggttggcttggctgaacaagccggatttatcaagaataacaaaattcctcgaatcggtcacgcattaattgctgattcttcaaccatgttagttggatctgttctgggaacttccccaatgggcgcattcgttgaatcttcagccggaatcgccgttggtggtcgaactggatttactgccgtcatcgtgggaattctgttcattttaggtactttcttctcaccattattgaccgttatcaccagccaagtaacggcaccagccttgattatcgttggtattttgatggctcaagcactgaagagtgttcactgggaacaatttgaaattgccgccccagcattcatcacacttgtcggcatgccattaacctacagtatcgccgatgggattgcccttggatttattacctacccaatcacgatgatcgccgctcgtcgtggcaaagaagtcagcgccatgatgtatggattggcagttgtgtttgtgatcttcctttggatactcaacaattagagcgcgacaaggtctgaaagaaacacttaaagaatctgacaaacatattctcttgcgccaaattcaactcttcgggccaaacccattttgacctcacaccccaaaagcggtaaggtataaaggttgtttaacaactgaatatttaacaaggaaggaatttgttatgaattctaagactaatttgtttggcatcagcaacgttcgtgacctcacgaaagccgctgttgtatctgcactctacatcgtgatcacgatggtctttgcagccttgagttttggcccaattcaattccgcttttcagaaggtttgaataaccttgctgtcttcaataagcgttacgttgtggcgatcacgctgggatgcttcatttcgaatatgatgtcgtcactcggaccactggatatggttgtcggaactggtgaaacgctgattgcgctgttgaccatcaacatcgtcacccggttcatcaagtcactgccattgaagctggttgcatccgttttgatcggaaccttttacatgttcatcgtggctgcagaaattgcttatctcggaaacaccgccttttggccgaccttctggggtgcatatctgaccactgccatcggtgagtttgtgactatgacgattggtgctgtgttggtttacatcatcagtttgagatatgatttgaataagtaaatatgaaaaccgcaatcagaaattctggttgcggttttttagataaccgaatcgtttacctcctgtccaaaatatcttaaaatatagttgtgaatataatcacaatttttatttaggaggttccatcatgacagaattatttgcaagtcccaacacctatatccaaggtcccggcgagctgttcaagagcgccggatatattgaaaagtatggcaaaaaagttctcttgctgtctgatccgacagtgttaaaaattgttggtaacgactttaacgattatcttcaaaataatggcttcgacgtcacccttgcccagttcgagggtgaggcttccgaatccgaaattaatcgggtgactgagattggtaaatccaaccaagaccagatcatcattggtttaggcggtgggaagactgccgactcagccaaggcaattgccgacaacctcgacattgctgcgatgatcgccccaaccatcgcgtcaacagatgccccctgctcacgattgtcagttatctataccgatgatggggcgttcgaccattaccgcttttacaagaagaatcccgaaattgtcctcctcgacaccaaggtcatcgctggcggtccggttcacctactgatttccggaatcgccgatgcgttggccacaaacgttgaagccaccgacgttcgtgctgccaatgccgataacatgttgggcgccaagcaaaccatcgttgccggcgcgattggccaagcctgtgaggataatttgtttgaatacgccgacctagcgattgccgctaacaaggcccacgtcgccacgccagctttggaccacatcgttgaggccaacacccttctcagtggtttgggcttcgaaagcggcggcctggcagctgctcacgccattcacaacggcttcaccgctttgaccggcgacatccatcacctcacccatggtgagaaggtggcatatggcacattggtcgaattgattttagacggcagtgatcacgcccggttcgagaaattcctgaaatttgacctcaaacttggcttgccgaccactctggccaatttgcatttagagtcggcttcagatgaggacctgatgaaggtagctacccaagcttgcgatgagaacgacacgatgaaatgcatgccaaccgacattacgccggaagacgtcttcgcggccatcaaggcagtcgacgagtatagtaaagactttcagaatcaataaccagttggttcaacccgatttttgaacttataatgtacgcaaagacagcggctatcccattctcggaatagccgctgtctttgtttaaatggcccagatgagccaatattaagatcgatttattttgtctcagtcgtcacaataatgcggccgtcatgctttttgctcaataactcgtgtccttggatgacaccggcgacggtaaatggcagttcataaccaattcgaattgagagcttcttctctgccatcaatttcaacagtgcggtcaaagcttcggcatccgaaattgcctttgtcggcataatcggcttgaactggaactgcttattggataacggctcatccccgccaaccgttgtgatgatgccattttctttcacaatccgggcatcgctgtcactatcggcaccattcaaggccgaattgatcaccacgtctgcccggttggcgagaaccagtgccgggtcctgcttgttatatgagacgtactcgtcaactcccagcgatttaacgtaggcttcgttcttgctggcaccgataccgatgacggttgcgcccaaattaagcgctaactgcgcagccagcgaaccgacgccgcctgaagcaccgcgaaccaccaccgtttggccggccttgacttcaccaaagtaataaactgctttgtaggcggtaatccctggggtgacaatcccggcagcttccgcaaacgaaaccccatcgggaatcttgacggttcgagcagcggtggcataagcgtattcagcgtaagccccatggccatgggcaactactcgatcaccaacttggaagccatccacattggcaccaagcttggcaaccgttccggcaacatcccgaccaggaattacctgatgagtagtcgccttatattccccagcccgcatcgatttttcaaaattattcaggttaaaggccttggtctgaatcaaaatctgatcgtcggaaatttccggggtcggcacctcgtattcttcaaaaacgtccgcagccccgttatgatcgtatccaaatgctttcatcactagcactcctatccctatatcccatattgtttaataaaattgtaagggttatcaatttggttatcaaacaaaaggctcttctgcgatcaaaacgcctcgtgccccactctcaaaaataggacccaaccaccctctaggtgatcggatcctatctgaaacatgttgtctgaaaggcattcgaaccaatcattgaccaattcatggtcggtattcgtatcatttaaatatcttctgcagggtggaacggcagactactcggatctaagctcgctggcttagtacctacattattttcggaaatccctcgtctgtcttgcaggtgattagttcattcacctttcaccattattatataatttataagttagcggtacaaccaatccgtcttcaaaattattcctgcaagtcgcggaagatttcctgcattttgctttcaatgtcgaataattcactggcatattccttgagattaccggtgtgctgttcaactttttcttccgggacatccgtcttataacgtaacttgtgttccaagctggcccacatatccatcccgatcgttcttaactgaacctcgattggaacatcaaacacaccgttggattgaaagaccggcaccgacaccaccaaatgcaggctgcgatagccactgggtttgggatccttgatgtagtccttgcgtttgatcaaggttacatcggattgctgagtcagggcgtcttcaacccgataaacgtcatcgatgtagttggtaatcacccgaatgccgccaacgtctaaaattttgtgatgaatggtatccatgttgagtggatagccttttcgctgaattttacccaccaaactgcggacacttttcatccgttcttccatatgatgaatcgggttatggtcataattcattgaatactcttcgtccaggttctccagcttagtgccaatctcgttaacccccgagtgccgcaattggtagatttgggctaattctttgagatcgccaatctcgcttttcatgggcaatttatccaactctttcataatctgcttaacatccatgaaattactacgttctagtatcatatttgattccaccttacactttcaaaatgttacaaaattggtgacagcagcctactaaacgtctgcttaaacttcagccacagcgactgttgctcaaatttttccggggtctgcaattcactaacatcaatatcatttaagaagatgtcacgcaaatcggccgagaacttctgatcataaataaacgcattgatctcaaagtttaatttaaagctgcgataatccaggttcgctgaaccaaccgaagaaatcttgtcgtcaatcaccatcgttttggcatgaatgaagccatcgccataatagtaaattttaacgccttcctcagccagttggcgggcataatactgagtcgcccggtagacaaatggatgatcgggcatgcttggcaccataatccgcacgtcaacgccggacatagccgcaatccgcagggcatccatcatactatcgtctggaatcaggtagggagattgaatccaacagtaatctttggccatggtaatcagcttaatataacccattttgatctgttgcaaatccgaatccggtccgctggagacaatctgcatattgacatttcctttagtagtcgtaaccgggaagtatttgggttcaacttgatcctcatcgatttgatcccggggactggtggcgttccaatccagaatgaaccgggcttgtagtccgaagacccccgacccaataatgcgaatgtgggtatcccgccaattgccgaattttttcttgcggcccaaatactggtcaccaatgttgaagccaccagtatagccaatagttccgtcaatgacaataatctttctgtgatcacggaagttaatccggaaatccaagagaactgagcgggtgttcaagaatggaaaggccttgccaccggcatcaaccagaggctggaagaacttccgggttgtgcccatcgagccccaggaatcataaatcacccggacttcaacgccttcatgggcttttttaactaacaggtttaaaatttcatttccgatctgatcattgtaaaaagtatagaattcaatatgaatactctttttggcagcttcaatgtcaccgatgactttatgaaataagctgttgccgtcagtaaaaatatgaactttattttgacgagacaaaaaagcgtgatcggttgtcatgaacatatcaacagcggtcttggcctcggtaacgacttcatcggccggtgtcttttcatcatggcccaattgttttcgctgttcgttaagtcgctcatctaactgcatctgaacgtgtttatgtaatttaaacaaccgattcttaggtaattttcgacccagaaaggcataagcaataaagccgaccagcggtaaaaagaccagcactaacagccaagcccaaatcgcggcaatatcgcgtttctccctaaataccgtgaagatcgccaaaattgcgttaatgacgacaattacattaaataccatcgaccaatcaatagtcattttttcctccccgcagccacttttaggctaaaataagaatgcatactgtaagtatactagaaagaagcggaaaaattatggatttattcaattttcttattgcgggcctccatggggtccactcaattcgttttattcacttcatcttcaatgaacaaccgctccttggcatcgggctgatcgtggccttggtgctgtatatgatttatcgttatatgaaccgataatacccatttggaaatccgattaagcaattgccttttagagaacggattccctaattcatttatgaaacacaaataggcctaagccacgaaggcttgggcctatttgacgcatacctgcttcagcacttggggtgtaaggcgaacgctggcacacagtgacttaatgcaataagggcgtaacaaaatactaagtgatcatgataacttttcaaattattttgaaagcggtaccatatctttaatataaacttctgggcaagcaaccacactgttaaaaccaatttggttttaatgacctacccctttttgccgatattcggccggcgtcactccaaaaattttcttgaagttcttgtaaaaatgactcacatcggtgtagccaaccttatcaataatttcttcaatactcatcttagttgagatcagtaactttgctgcctcacgcattttaatatctctgagaagctgagagaaggaatacccagtttcccgtttgataaatcgactgatatagccttcactcaaattgaaatgttgagcgagactttccaagttcacatctttgcggttgacacgaatatactgaataatgtttgaaaccggctgctcgtcaatgttgccttcaagaattgtggcatcgtcagcgtgattgcgaataatctgaccgaacaacaacaggacgtaactgttcaggatgatttgagatccatgcatggatgcttgagactccatgtacaagccaaaaatgatgtgttcaatctccttgtcattatcacaatgaaccaacaccaactgagagaactcccgacgatacagcattctcaaaaagaagttggaaatatcattttgctccattagcagaggagaaaatgcatcctcgaacgatgatcgccgcataataatgttaaccacaatatcgtcgtcagcattacagaaaaacgcctgtttgaggtttgggggaacaatgaccaggtctccctgttccaaatcataggttttaccgttcaggaaaaacttgcaatgcccattgaggacataggagatttttacgaactccaaagtatgttccataatcggcagataacgcaaatgcttaaaaacaacaatttcagaatttaaatggggtggatagatcagcttggaattggaattgccattttgctcaggatgaatcacagtctgtgaaaagaattcactctcgaagaaccgcggacgaatgtcagaaagtggttgatctggaaatttcacaggattcttcatctttgctcgatactgatccgcaaaagcttgccaagttgaaaccggcttaaaattgtcatatggattggcgacatacaacttcttatactcaatttcagcggtttcaagtttcattaatgaatttaaacttggagagttcaatactttcacttccttgaccagacaaacaatgaccggtgacaacagtccgtcgtcccagtcgatcgtttgcaactatttaagatgcttggtaatcaaaactattttcatagtgtccatccctgagttcaactgtgtcatagcctggaatgtcgacttttgcagtggcgccatacggaacgtcaacggaaaccgacagcttgccgtcagtgtaattccattcaaccttggctgttccaaatggggtttcgtgtgaagccttggcagacgttaagttaccacccggacgaggggcaacttcgaactggtgccaagccggggcagtcggcttaagaccaccaaccgttgcatgaatccaatccgcaactgagccaagtgaatagtggttaaacgacgtcattacaccagggttaaccgagccatcgggcagcattgagtcccaacgttcccaagtagtggtgccacccattttgacttgatacatccagcttgggcattcttcagacaggaacaattgataagcctcatccatatgacctgtctcagtcaatgcaggcaggatgtaaggggttccagcaaagcctgtgccaattttaccatgagcgcgacgaacaagtaatgccaacctgtgaccggcaaattctttaatctctggatcgtcatccaccaacccaaaggcaattgccagtgcataggcacattgcgtgtctgaagtcatgatacccttgtcgttaaagaatcgcttcttaaatccaagatgaacatgcttggctaatttggtatattcatcggcctcatcatccttaccaagttcgtgacccattttaacaaacatgtcacaactattggcataaaatgcggttgcgactagattcttttccgtcatggcttttactggatcatccgctggtgccgtgggatccagccagtcaccaagttgtcccagtgagtatgccggcttacggtcccaaacaccatcctctgaaaggtaacctttaacctcatcgatccaacctttagcagtttcatactgcttggcaagcatctctttatcaccacttgccatgtaaattgcccaaggaactcgaacagcagaatcaccccaaatggcaatgccttgcggttcagtccattcagcaaatggaataaatgggacataaaacggtactgttcccaatcgcttttgttcatgtgaaacatcttgaagccagctgctcaagaaaccttcaacgtcgtagaaatatgcggctgtggggctgaacagtgagatatcgccagtccaacctaaacgctcatcacgttgcgggcagtcagtcggcaaggaaacaaagtttgatcgcattgaccaaagcgcattgtcatcaagccggttcacattctcattagaggattcaaaagtcccggtttgcaacatatctgagaagtagactttacactgcatatcatcggcagtcagttcaccgcgccaaccacggatttcggcatatctaaatccgtgggtggcaaagcgggcttcaaagtgtgcatccgacccgtttgaaatgtattgatcaatttgttgacctcgacggagtggccgagtggaaagtgacccgtcactttccaatacttcggcgtgctggagttcaatcacatcgccatcctgcgcgttggtaatatgcagatcaatccgttgagtacagttttgaccaaagtcgacttgccaatcagccttgccatcatactcgcgaatttttttgattgaaatcggcttgttaaccatgttggcacggactggtggcaggattggaaactccatcttccgtcgatcaaacggaatttgggcaactggcagccaatcggcatcatcatatcctggttggtcaaaaccgtccttctcaagatgcgaatcataagtctcaccttcacacaagtcagactgggtgattggccccttggtcactttccataatccatcatgtgaattagagaaaatctgctcgctggtgccgtcaggataagtcacttccagctgcgcgaagacaccaatcttgtctccatagacgttcgccttaccgcctttgaaaccaatccggccgcgataccagccatcacccaagtaaaagccaaacgcattttgaccggctttcaagtcgcccaccaagtcgtaagtccagcattccagacgatcatcgtaggctgtccagcctggggttaagatgtctttgccaatttgtttgccattcacatgaccttcaaccagaccaagtgcagaaaggtaaagtcgtgcatatactggcgtgtctttaagcgtaaactcattgcgaaccagtggtaaatgacgatggtcagtttctgcttccggccagctcggaccaacaaagcttgattggagttcccagtattcaagaattccttcatcaaatttaagggtttgtgaccagtcccctttggtatcaccatcaaccagacgggcctttacttcaacctgttctctagaaaccaatggatccaatggccaggcaaacaaaacgttgttaaccggttcggtaacaattgattcaactgtcccagcttgacctggcatatgccgggtaatttggagttcgacctcatctgaatcagccacatggccatcatacttccatgaaatccgcggagtagcggttctaatggctaatacatcgccgtgatagtgttcaacttgtaaatcatatggtgcttttgcattaacaatcacagacattctaaaaatccttctctcttatcagattctgttttgacattaactaactcaattatttttcaattccatacttgcgctgcagacgaatcataattgcaccagcaatgaagctgacaacgacgactccggcaaagcaccacatggtaattttgatgacccctggtaaaacgagggctggggtaacgaaagcaaatagtgcacaaacaacccgtgatgttccgttgataattccttgaattgaagaacgaacctcaaccgggaatgactcttgcgtccaaactttatacaaagcttcaccagccattggactaccaatgttgtagaaaccgatcgcaacgatgattgcgattaagctaccgccacccattgtcattccaaccatggcaaggaacataataacggcaccaattacaaaccccgtattacggtatttgcttccggcaatggatgagaagacagcactgacaactaacgcaatcacgtttagaacgattccggcaccggttgccaaactttgtgaggcattggccttgaccatcatgaaggtctggaattgaccccaggtatttgcaagcaggttccaaccaatgtagaagatcaaaattgcaatgaagaagtacaagaactttttgttttcgccaaacaaaatcttagtaactgatttagtcgcaacttctttactgttcttgcgattttcttcgtaacgagctgttccttcgtcatggagttctttgaatttgcttgacatcgtccgccacaaccaagtgatgattgcgaaaataaccaacagtccaaagacgattcgagccccggtggcaccggtcaaaacggcgaaggcaccaatatatgaaataaagatgccggcctgccaaaagatttgcgttgatgacaccaattttgctgaagttttagcatcaggcgaatctcttgaaactactgtcaaagaaatcggtaagtcggttcctgaggcaatccctgtaatgacgaccccaattaataacgtgatgtaattcggggcaaatacagcgattccagcaccgattgcgtagaacaaattgatccagttaaagactttaatcagaccaattgattcagcaatccggccgccaaacaacgatccaaaagcgatggcaaatgtcaacgcaccggaaatgatcccgacttgaccatttgtcaatcccaatccggattgccacaccgaaatggtagcagccaaccccacaataatgcctgaaccaagcatcgaaccaatcccggcggcatacgccaggggacggtaatatgaaatgtcttttgtttccatagttaatgagtctccttatttgctgctaaattttgattgtattttggatccagtttgcgagaactgtatactggatcgggaatatcatgatgggcaataaagcgcataacgagttctgcagataaccagcaaatccctagtgacccaaccaatagccaaattaataatgttggtgaataggccatgattgcgggtgtgacgaacgaaaagactgctgtaactgcgcgaacaattgaatagctaataccggttacgcttgcccgaacatgtactggatataatgactgactccagattttgaataagggttcaccatgaagcatgttggcacagcagtaaacaaaatatgaaatggtgaaaatccaccaaacaccaccgaacactgctgagagaacaaatgataagatacacagaattagaccgaccctagtcataatgtaacggtacttcgtgtcagcaaacttcatgtagatgccgtagaggacaaatgcccccaagatgttggcaaagaatgcacacaaagtggaaaattgctggctgcgaccatcgacggtcaccaaaaagtagttcagaaatgatccccaggtgttagccggaatattccaaaaaagatagaaaccagtcagcccaatcattggcacaaagtaccttggcatagcgatgagttttcggaaaggaattttttctgcggcaacttcttcctcagtagaagcccgtctttcaactgggacaaccatttgagtctccagattatgaaacttcggtgaaagggcacggattccccaagttactaacgcgaccactgccagccaggcaaacaggattctggaactcatatagcccatgtcagctgtcaagaagcccaatccttgagaaagaacaattccgcccaaccaataaatttcggttgaagcaatcaccttaccgtactgatcaggttctgttcgttccgaaataactgccaaggaagtcggtaagtcggcccctgaggcaaccccggcgataaacaaaccaaccacaatcattggcagatttggcgccaaggcgactaataatgttccaagggcaacgaataaaatatctagattgaagacggtgacccggccaaacttatcagagagataacccccaaccgccgaccccaaggcaacagacaatgttaccaatgtactaagtgcgccaacccaccacgcgttcaagccgaactgggttttccacattgccagcacaattccagtcgttaccaaaatgcttgcgtcaagatatgaggcaatacttgcgttcatcgtcaacatccatccagatcttgatcgagacttcataaaatacctccattcttataatcaataatatgtggaaccgctttcgtaaacgtttacaggtattaggatatgctcgggatgaccattcaacaacgtttcaacttattggctttttatgacatgcaaataaagccactcttcatccggatacatacatgtacgctggacctgcatccttgagacaaaaaaacggaaccagtcaacggcaaatgtttgtcgttaattagttccgtttttttaattgatatttatttgagtgtcgccgcaatcagcagcatcatcggccgccttaattcatcacgcatctcttggctctctgccaacattttatgagtgggagtcggttcaacgatttgatctaaattaaagcctcggttcagcaatgtgttcaagtaagtggttaacgtgcggtgatatttctcaactggatagccgagaaaatccgtggtccgtttggattcgtcaaagtagcgatccaccggccaataccttggccggccatcgtctcagaggatccattcctcgtgaccttctgcggtgaagatgggatgttcaacactgatgatcaatttaccgccgggagtcagcttatccttaatcaagtcaatcaatccggcataatccttgatataatgaatcgccagcgaactaatcaccacgtcaaaactgccggcaagctgattaatcgccatcatatccaatacttgataatgaatttgggcttggtcggtcattgatttggctttttgaatcattttggtggatgcatcgattccaacgacttcactggcgccatgatcagcggcgtatcgacagtgccaaccgtacccacagcccaagtcgagcacgcgtttgccatgaaaatccgggaatagttttctcagttcatgccactcgccggctgcattcaggccatcctttgaccggttcatctggctgtacgcttgaaaaaatgctgcatcatcataaatatctgacatcgtcaatctcctacttatcgataaagttccggccgccgatcctcaaataccggcataaatccgcgggcatcgtcagtttctttggtgtcaatcgtgaatacttttaattgaggatgatcgtctaaagtcacaatttcatcccccattggattataaatgcctgaatggccgccaaatggattgtccggatcactgccgacccgattaacagcaaccacaaagctttggttttcaattgcccgagctgccagtaatcggcgccactgcgggattcgtgaagtcggccactcggcaggcacgaacagaatgcgactatcgtcaagactcaaagtccgcagccattccgggaaccgaatgtcgtagcagatcacactggccgcatcgatccctttgatttgaaaatgattttcttcaaccccggatgccaaatactcatcctcatgcatcaaaccaaaaagatgaactttgtcgtaagttgtcagcagtttgccgtcaagtccaaagatataagttgtattgtagaacgcaccattcttttcagttgagaccgaaccgccatgaatggtcatttgatacttcttggccaatttccccaataaagcctgtgtccgctggccgttcttatcggccacctgacctagacgggtcaaatcgtacccggtattccacatttctggaaaaacaacaatatctgcgctttgttcggcagctttttgaacatttggttcgatttgggcgaaattttcgtctggatcaccgaatgtaatatcaagctgtgccaatgcaattttgatcttcatgtgaccgtctccctgcatttttgaaaattatacaacaaaaaagcacattcaccaatcactggcaatgcgctttgacgacgttacataattgcggtgattgcggcgatcaatccaaatatgacaccgggcacatctgccacaattaaaatccaatcccgctttggcttgacccaaccgtaggcaacccacaatgccgcgttaatcgaggcacagaaaggctgaataaatgacgtcggttggccgttcaaattttgcaggatctctcctatgtatgagatatacataatcatattggcgatggttgcgatatcgccaatgactttctcctcactgaatacatggttactctcgtgtagttgatgaccaccagggtgactcaactggttttgcacactaatccctccaatttctcttggttcagtgataccatactcaccaagagaatgctagacgttgtcgagattaaattgaacaatttgcgtaatcagatcttctggcaagggctggtcgaccggcagttggatggcgccgatacttgtcttgtagccttccaactgatctttaaagacattgatggcctttgggccgggataaattccgatgtgattcttaaaatttgcgaagtgaataatgtttttgtggtaatgaaacgtcggcatcccatatgaaattttttcatcgtagcctgctggcatttgtttttggataatttcatacagttgcaaaagcttctcttgccttgctgttggctggttttcaatatattcccgtactaatttttccattgacctgacccccttgagaaaaattgttttgatctttttgattaaaatctgttgacatttacattataaggctctaatatacaaagcaacaattaattcgtccataaaaccgatgaagtggagatcaagatcattgtgcacgcaaagagagttgccgcagctgagagtgcaatcgaacgcagatgattaaatggaccactgagggttcttccgaaagttcgcgagtacggagaaacgtgttggtatacgtcagttgccggagggatgttagtcccttgctaagagtgattaattggggaacttaacagatgttttttatctaccctgattaattgaactaaggtggcaccgcggaataatccgtccttaacaatcaacttttgttatggacggattatttttttatctaaattgacggaggtcacacttatgaaaatggaaattaaacgatggcaaatcatagagtgaatttcaactacttatttcgaaactactatatgaaaatattcggaggaatttatcatgataaaacaagccattgaaaaagttgttaaccacgaagatcttacatttgacgaaagccaatccgttctcgatgaaattatgaacggtgaaacatccgaaattgaaactgccagcctcttaactgcattaacggctaagaatccgaccatcgacgaaattgccggggctgcatcatccatgcgaaatcacgctttgaagttccccgaagccggtaacgtcttggaaatcgttgggactggcggcgacaaagccaacaccttcaacatttccaccaccagcgcaattgtcgttgccgctgccggaaccaaagtcgccaaacatggtaaccgggccgcatcatccaagagcggggctgccgacgtcttcgaagcactgggcttagacatcaacgaagatccggccaccagtttccaaagcttgcaggacaacaacctctgcttcttatttgcccaggaataccacaaatcaatgaagtacgttgcgcccgtccgtaaacaattagggattcgcacgatcttcaacatcctcggaccgctggccaacccagctcacccaaccagccaactgttaggcgtctacgatgaagacctgcttgaaccactggccaatgttttaaagaaattaggcgtcaaaaacgccatggtgattcacggccgggatggtctcgatgagatgaccgtcgctgatgaaacggccgtcgttgaattacgggacggcaaattaaccaagtacgttttgacacctgaacaatttggcttcacacgagcagcccgaaaggacttggtcggtggtactcctgaagaaaatggccaaatcaccaaggatatcttagctggtaaaaaagggccgaagcgagacattgttttactcaacgccggatcggcactgcaccttgcccacccggaattgacgattcaagaaggcattaacctcgctgccaagaccatcgacgaaggtaaagcccaagcagagcttgaccgactgatcgccttctctgacaaacgcaaagacgtggttgcatgattttagatgatttagtaaccgcaacccacaaacgtttaaaaaagcacgaagctcaaaaaccactccaagaattaaaaaatgaagctgctcaaatgcctgccagtttgaagcctgattttctggacgttttgaatgaatctgggctgcatgtgatcgccgaggtgaagaaagcctccccatctaaaggaacgatcgtcactgatttcccgtatctccaaatcgccaaaagttatgacgcggcgggggctgatgccatttccgttctaaccgaaccggattacttcaatggtcgcctcaactacctgaaggaaattagccaggcagtttccgcgccaacgctccgaaaggatttcacgattgatccttacatgatttacgaagcgaaagccaacggtgcctcgatcatccttctgattgttgccatcgtcgatgaccagcaattaagagcctaccgagaattggcagagcgcctgggcatgcaggccatcgttgaagcctacacggccgatgaagtgacccgggcattgaaatccggtgccaaaatcatcggcatcaataaccggaatctcaaggatttccaagttgactttaaaaacagtttgaaattacgggcaatggttccagaaggcatccctgtgatcgccgaaagcggcatcaagacccaagcagatgttgaagccctggccgatgccggcttcaacggcatcctgatgggtgaaaccctcatgcgggccaacaacaagcaacaactgattaaagaattcaaagcagctaccgtcaaataaccttcaggaggtgtgtccatggttaaagtcaaaatttgcggtttgatggaaccggcagatattcaggccgtcaatgaagcgcaggctgatttcgcgggatttgtctttgcgaaaagccgccacgtcgtttccttaacaactgcgctggcactgcaggcccatttaaatccaaacatccaaaaaattggcgtcttcgttaatgaatcaatcgctgacatcttggccatttaccaagctggcgccatcgacattgcccagctccatggcaaaagcacccctgaagagattgccgaactgcagcgcgccggactcaaagtcattcaagtcttcgaacgccaagccatcgatccaaagtcgaccgccgactatttgatggtcgatagcggcaaaggatccggccaagttttgaattggcaggcagtcccccacgttgatcgaacaatgatcctggctggcggattgacgcctgacaacatcaatcaagcggttcaaatcgttcagccagatattgtcgacgtctcatcgggtgtcgaatccgacggcaaaaaagatcccaataaaataatgaatttcatcaaaaatgcgaaagaggaatatgtcctatgaaaaatttaactgaagctcaaacaaccaaacgaccaggaattttcgccgatacatacggcggccaatacatccctgaaaccttaatgactgaattggaaaaagtcgataaagcctttcacactttgaaagacgatcccgacttccaagccgaattacacgatttattaatcaactatgccaaccggccatcactgctctattacgccaagaacatgaccgaagacctcggcggcgccaaaatctatctcaagcgtgaggacctcaaccataccggtgcccataagatcaacaacgttatcggccaagcgttactcgccaaacatttgggcaagaagcgcctgatcgctgaaaccggtgccggccaacatggggttgccaccgcaaccatcgctgctttgttcgggatggactgtgaaattttcatgggtaaagaagataccgaccgccaaaaattaaacgtctaccgaatggaattgcttggtgcaaaggttcacccggtcaccaccggctcgatggtcctcaaggatgccatcaacgccacactccaggaatgggctagtcgttccgaagacaccttttacgtcatgggatcggctgttggcccctacccatttccagaaatggttaaatatttccaaagcgtcatcagtaaggaatccaagcagcaactgaaagccaaggaaaacaccttgcctgacatggttgtcgcctgtgtcggcggcggcagtaacgctatcggcagtttcgccgattacatcgatgacccaagagtcaaattagtcggcgttgaggctgccggtaaaggcgttaacagtgatcagaccgcagccaccattgaacggggtaccgtcggcatcttccacggcatgaagtcattattcctgcaaaacgaagacggccagatcaacccagtctactcaatctctgccggtttggattatcctggtgtcggtccggaacacgctgccctggctaaagaaggccgagcgcaatatgtcggcatcaccgatgatgaagctgtccaggcgtttgaatacatcgcccgacaagaaggcatcgttgccgcaattgaaagctgtcacgcagttgcttacgtcgaaaagattgccccaaccatgtctaaagatcagattatcgtctgcaccctgtcaggacgcggcgacaaagacgttgccagcatcgccaaatacaaaggagtcgatattgatgagtaatttatccgcaattttcaaaaatcataaagcctttattccgtttgtcgtggctgacgatccggattttgataccacagttgccaatatcgtcgccttagcagaaggcggcgctgacatcgttgaagtcgggattcccttctccgacccaatcgctgacggcggcgtgattcaagcggccgacctgcgtgcttttgacgccggtgtccgcaccaagacggtctttgaaatcgttgaggcagcccgtaaacaaaccgatgtgccgattgtttttctcacttatttaaacatcgtcttcaagtatggttacgatgcattctgtaaaaagtgtcaggccctcggcgtttctggcttggtcattcccgacatgccctatgaaagccgtgatgacatcgttccaaccgctgataaatatggcatcgacatcatcccgctgattgcgccgacatctggccaccgagttgaaaagattgctaaggcagcgtccggattcatctacgtggtttcctcactgggcatcaccggtgaacgaaatgaattcttcaatggtttgaaggatctggttgccgaaatcaaatcgtatactgacgttcctacggcaatcggctttggcgtccacacgccggagcaggccaagacgatggccgagatcgcggacggcgtgattatcggtagtgcgattgttgacattgttgcgaagcagaaacaaaatgcccctgatgcggtaaaaaaatttactcaatcgattcgttcggctgttgatcaagctaaaactaaagaagccagtgtctaaaaaagtccccggtgcggataagcactcggggactttttttggatttatgaaccagtttacgtagttattaccaaataaatccagtatagttagaatctgtggagaagttaaggcggtggcgcttctaaatggagatgatgcctatggtgtaaaccatcaaataggaatttcagaaactctagtaaaaggagagcccttggtgtccgtttcggacgctctacaattaatggtgtcctttggtatctttaccattggactaatcaccttagttgtagagttaatcaaaaattggcaaaaaaaataaccgcccataactttagccagtttgcggttatttaataactaaaaatgcgctgccgtcttaaacggttccacaatgggaagtcctgttgaatcggggcttcctttttgtgatttcattataacatggatatgagactatcgacaaaacaaatctcctaggtcgaggtaaccttttacggatttctagtgggacattaaagcaatattttgcccctcttatataaattatttctataatttacgtttccggagaggatctgcaagtcaacctccacatgctatactaaaataaatgaactagtggaggatgatatattgataaaaatcgctgtaatcttaggatctatccgcagtaaacttggtgaatccattttcaaatatttacaggccagctttcctgactctgatcaagtgacctacgattggatccggctagaagacttcccgctggaaccctatcaccatgatgaaacgccattatccaatccgattaccggcttaaaagacaacgagcaaaagtggctcaaccgattgaaagccgatgatggcttcgtgatcatgacgcccgaatatgatcacgcaattcctggcgttttaaaaaacgcattggactatgtcggcccggaagtggatcacaaaccggtccaaattatttcgtattcctactatagtgacggcggcatgctggcagcggaatccttcgtggaaattttgcaaatgctcaaaatgatggtcctgccgacgccggttctgttgtggaatgccaatgataatttcacccaggcaggcgacctgatcaaagatgccgataacagtgaccattttgaagcgcgactgaaagaagcttttcacgagattgccttttacacccaattactgcacgagcacccatttaaataaatcagaggtcagtcatgcgagccattttacccaacaaaactgaattcatcccccacgcccctcaaaatgagcacgaaatcttcatggcgatgcgcacctatcccgacaacgtcaaagtctaccatccccatggcagtattgacgccacttcggtcttttggcataacaagctacacccaaatgccttgaacttcgctgtgtatgtcgatcccaaggccaccgaacaagatgtcttgtttcaacgtgtctatgaggatattaaaaaattagcctggaagttcgatgacgaccgcatgatcacacgcgactatgctcctcagcatcctttcaatcagtggttaacgacgaagcacttccggttggtacaaaccgcgttgaccgcaacagtggatttaggcggcctatcactaaacgcgccgactgcgtcaggggcgctcaagacgttcgctgaagtatcatcgcaggattcactctaccaatccgtgctggaacgtagcatgcgcgaatacgccggcaaaccaacttttaatccagcgataacgatgccattaccagattggtcagcactcatctcacatcgacaaatttcgacagccccattcgcgttaattcaagacgatcagctggccgccttcagtttcctatatgaccttggtgaacactcggttgaacttggccaaatgaatgcgactaatgctcaggcgctaaatgagttattgaaccgacagcttcagtggcttcaagacaactaccagaccctggctggtgaatttggaatggccaaccggctggagatgaaaatttttcaaagtttgccgtttaaagatgttaacaagtacgaaacttatatgcgtttaacgtaaaacagactaacccttgtagtgaaccccaatcccgtcggatctgaattcaccacaaaggttagtctgttttataatgctttaacaatgtatgagcggccaaacacggtcattgccttctgcaggagatttaaactgacttttaagctgccattttcaattttggcaagctggctttgttcaatgccaatctttttggccagctcaacttgagtcatccctgcttgacggcgttggtatttaatcgtgtaggcggcgtcagcttcagcaggaagctgaagaacttcattcaaaggcttattagcttgagctgctaaaattaagtcggcaagttctgaattcgtcaagcttcggccaattgcctgactgataaatgatagttctcggatgccaatcgtgccattgaccagttcagaaagcctcgaagcagcctgctgatagtcagcggagtcagcccgatcattttcaataacagtgttcaaatgatccaacgtattaatcagttctgtcttaatcatgtcagatacctctccacggacagtacttttcaacgactaattttctggcttgagtattgaaaactatattttgtgaagacaaaaagttgccacctaagtgcttataaaaggcctctgtcccatcggatttgctaattaattctacatagccttcaaatccatcttgcaagaaagaatcctgcattacaagtgacaatagcgcagctcccaaacccaagccacgattttctttttgaatttcaatcagaataactcgattaaataagctctgatagtcacgaacaaatccaattagcccgactaaatttgaattaagaaatgcaccaactaaaatttcattaggtactaactgatgccaattaaagataaatccattcgtatccagtgacaaaattttttcagtcacaacatcaaaagtaacatctttcattttcaattataacagaatattccaaatttgaatattaccaatcttattctgccttctcctcaccctttagatacgaagaaaagtaaaccactctctattgaaaatgcttatacctaaaatacttataaccaagcttatgatcaaacatcgtctccgataggcccgtccgattcgccataaaaatataaatcgcaagagccaccagaccaaagacgacgcagtaaaggaatgccggaatcaaacggcttggcatgatcaattgatgagttccccaagtcagtgccatcacaatcacaaagaacagcaggttaaccaggacactgaccttcaatcgtccaaatgggacatggaactcatacataatttcgccataacttaacagacaaatgaagccaaaaccgatggcggtggaaatgatcgctccaaatccttgaagcaaaatgaccaatggaatttggaacagcaatttggcaaccagtccgacaaccagataatacatggccttcttactgtagtgcagcgcttgaagtagggttaggccattaatggccagtcccaacattaaactttggagaatattggctgccagatatttcccgccaagcaggctgaatgagaagaagatcccattagtttcatacgacagcccacacagaatggtcacgatcggcagcaggacaaacatcagcatgttcacattttgaaagatcaaatctccgacgtcacctttcttggaggcctgactgtttgccagcagcggcagggtcgtctcggccacagccaatgccagtgaaacgaccaccgtggtaattttggttggattggcagaaaacagcgtgtagatgtactgggtatattcggccgaaaaatgctggacgccctgcataacctgtttgaagaataactgatcaatcaactgactgagggtaatcccggagccaacaatgacaaagggaatcgattcataggcaatcatcgtgaaaatcttcttgatactagtcaagtcaaacggcgcgctcttcttggccatttcagcgtaatgcgccgattgtttacgataatacagcccgaggtaaaggtaactggccaaagcgccaacaaaggccgccatgacgcttaaatacaccgcctcgatataactgcggtgaaaaacgtcaatcaccagatacgttgacaccagaataaagacaatccgcacgaactgttcccagagctgagacacgccgtacggtttgaggtcttggttaccctggaaccagccacggacactgctcattgacggcaaaatcacaattgccggcaccagcacgcgaatcgaagtcacagcactttgagtggaaaccaccggactattcttggcgattagcggcgcaatcacccaaaggactgccccacaaacaactccggagagaagcatgacaaaagagccaactttggcaagttgacgtgaattcaaaaatttattttgaccgttataaatcgcaacccgccgggcaattgcggagggaaatccggctgttcccagtgcgataaagaggccgtatggattataagaggcgttaaataaagccatggcaacgttcttgtgctcgggtgacccaatcatatacaaccacggaatcaggtagaggatccccagaacccgggaaaagatactgccaaatgaaagccagaaggatcctgacataatttttttgttcatggcgacatgcacactttctatatttcaatcataaccaatattataatatctttcgcaaaagtttgctatcaaatcagaaacttggtttgcgttttttgagaacttgttggtcttaataaaaacagtgtccaaaacaaaaacaggaaaattttgttttggacactgttggttttaatttgtttggttgcgaaatgtgctactcagcccagaccctaacgtataaggcaaaaagccgaatcaaccagcatagcccgctggtcaatccgccttttcgccttatacaccggggctaactgggctgatccgcactctagtcttccgatacctgcgcgttcttttggatatccggtgacagatcgtacatttttgctgcttctgttaacattgcatgatatgaataggcgccatccttatatggttcgatgacaacctcgtcagcaatctttgaaaatggcttcttgccgtcttttacctgtgctgaatccagatctgcgacaattttcttctccacgtcggaataactgcccacaatctgcttagtctctaaactgccttgtatcgaaattttactcattagcaattcctcacaatcatcagttatatttagtgtcatcataccgccaaaagagaagcgatatctctaggtacatcataccaatttattgacccttatttcaccaaaaatcgtaaagaaagtcaaatttaattttttaatgtcaaatgaggttaccccagcaaaaaagcgcccaacacaagttaatcacttgtgtcaaacgcctaaatacaatttattgatgatagaagtagctggtctgggccttatgcgtatcacttgatttataatacatcttcaaagccgtcttgccgttatgcttcacgtgcttcaagtacacaggctgattctgtgacaacaaggtcaacttccagtaaccgtgactgttcgctttattggcaaccttgaacaagtaagacttgctcttagtttgtcgatattttttgatgttaacgtaataggttctggcatcggctttttcagatgccttcgatgagccctgacggaatgaatatttggtcagccggtacttaaccggaacgttgccaaacaggtcatcgtgatacttaccaaaccaagttccctgcagcgtcgtcggaacggcgtgggtcgtggtcttggcggcagccggctgcgcttcgatggcaatgatgccaactccaagcgtaacggcgaggaatgataaagttttgctaaatttcatcgaactgtcctttcatttgcaaaaaagcaattggaagtagtctaacagataattcaatttcatgcaaaattccaaactaggatacgacctattttgattatcctactaaattggcagttaccacggaatacaaaaagtcagctgaaattgatcatcatcaattccaactgacccacttttccatttggtccaacatcttcaactccttaaccgatattcaaaccataatcgatcttcgtatggtttgaggactttttccagctggttgcggacgatattcacccgaagatccgcggccaaaatcagcccacaaatcaccagaatcgaaatttcaatggccactaagccccaattctgcttggcgtaaattaccagggcttgctgaagggctagaatcgccaacatcgtcccggtcttattggccaaaaaataccaacgattaatcactcggaccttcttttcggtcaaagcccgcgcttcggctgataaattaggcgcgtttgccaatgccaatttgagccctttggcgtccttcttcagcagctcagaaatatatgtcgaggtcttcccaacattttgcttcgcaaagaaatccccaaaccataaactaatcagaaaaaaacacaagaaaaaatctgctaacttcaacgtgtccgtcatcgtaatccctccgttctggcagcgactgcggttaacccccttgacaagttcaacgatggataggtaacttatcgttcaatcactaatttacttatcctggtacgagcagtatataacgattagctgggctttggtaataatctgcttgtgagattcgggtcgtgtgtgaggtagccagatacaaataaatagacgatactctttgctggtttcacaaagaatatcgtctattggcttggcaggaagcgaaaatattggcaatcgctacctgcaacacctcatcctcaagcttccacaaagtcccgacccatcttccgatcacagaccatcgcggcaacggccaatccaaatgagcagatgccaaaaatcagccagctggcaaacacaccttgactccccaagttggcgacggttaggaaaaaaccactgccaattggtgcgccaatcaggagcaccatgttaatgaaccccattgatgcgcccagccggtcatcgggaatcagtttgatgaacatggccgagacccggggattgattttacctaagaggtagccggtaatcaccgagaccaccgcaatcaagatgatggatattcccgttaggaatgttgctgccaacaacaccagcatccaactgatgtaggctgccaatctgacaacggttgtgtttgccaaaaagtcatgctgaatgacggcgccaagaatcattcccaaggacatgctgatgctgaccaaggcaacactgttgccatagttgcccagccatagcgcctggttgtgcagcaacgacacattaatcaacccggtcatcccactggcgatcgtgttcatcacaaatgcgaaagctaaaataaccacaaccacctttttggacatcatgaaatgaccagtcacgatcaaacttttcagcaaggattgtttgggcgtggctgattttggctgattaacgctgagcttcggatcaattcccttaaaaattgaccgccgagtccaaatcacgattgccgcgattaggaaagtcgccgcattgatggcaccaaacagcccgtagttatggttcagccagacaatcgcaacggccccgacgccttgaaaaaccatctgcaaagtcgtttctgtcgccatttcaaatcccattgcatcgttcatttcttcgttggggattaaaaaccggaagtacggtaattcaagactgccggaaaatgttcccagacaatcgctgatcacgttaatcgccaacaggcccccaaagaccagcgtcgatcccggaaggccaatcatcagggctaacccaataaacaaggtaaactggctgactcgggcaaggaccatccactcgtacttatgatgggtattatcggcataatagccaaggaccacgttaatcatctctggtatgtaggttatgaatgaggcaatactgacggcggccgttttgaatgacaagctgacagcataaatgataaacacaatattgaacaggctattgccaatcccgttgaaaatggcagcgttcatcaatgcccggtagcctttacttctaaaatatgagtgcatgtgatcccttctctctcaatgcttgcttatacattatctgagaattacacttagagtattaaaattccactatatgagaattaatttggggtgatcagatgcaagaaccgggatgtttatatcgtcagttacgaaaagaacgccatttaacacttcagcaggtagctgacagtgaaaacagcgtttcatttattagtaaatttgaaaagggtggctcacagattagcttcaatcgaatgattcatctgctgggcaaaattaatttttcagtcgaggagttcctctatcttcaaggacgcgacaccatccagccaatcaagtcgacgttcatgtcgcaccatccaatttatctgacagcgccgttcatgacgccgatggtcacgttactcaacagtctgacgggcgattcagagacttcagcgacgttgccccggtcgatcgaacaatacgacgctaaaatccaccagcttgaggatgccggtaacctgaattggcaacactacttggcgattctctaccaaattcagcaagtcttaattcaaaacgacgcctcaccagcaggggatccgaagaccgcctttgccaagctgcgccaactgagccggcccatcgtgacttacctctataacattgacaattggagtacgtttgagattttgctctttagtatcagccactttgccatgccgcttcaaaccgtccatcggttgagtaaaatcgccatcaagcgaaccaccagtacagaaaccttcccgatgatgccgcaaatgagattcgaactgctctttggcctattttcaacctacattaatttccgccaaatggcttgggcaaaggaagccctggactcaattgccaaattacttgaggaggatgccgatagcaactttgcgatcatgctgcggttttaccggggctggtacgattacatcgactcaaacggcagtgtcggtgaggaaatgatgaccgatgtcgctgccatgttcaagctattaaatctgcgccaaccagccgacctgattagcaaaatcattccacagattaaacgcaatcagcgtgatccggagaagtcgatgatctttctgttttgaatcaaaatcaatcttcccatttactcaaatccggtccaccaggaatgacccgatcaaacgaagtcaccggatcatcgctcacttgaaagaagtgctgcttaatagcggtgaaatcagtattttgcttaaatgccggaatctggtagcattccttcgcgtaacgccaaagattagggaaatcaaccaaccgttttttattcagcttgctcttgaaataaaacaccacatcaaagcgaatcaaactgaccaccagccaaaagtccggcagggtaatgtgatcgcccattaagaagcgcttgtcagcgagtcgccggtccaattgcgccaatcgatcaaaatactgattgaacaacatgtcgtattcggcttgcgagtcaacgtcgttaatcttgcccggaattgacgtgatgtcggtaataatgcgcgtgttcatggcgtcaatttcagcctttaaatcgtctggataaacgtctggcacattttgatcgaaatatcccctccaagatccgcccaattcaaacataatatctcgtgaagaatcattgaccacgccaccggtagttaaatcaatcaatgccggaaccgttggccgtgccgagaagttcgggacggcctttttgtaattctgcgacaaccgcgtggtatggagcatcggatcttcatcgtcagcgttcttgccaaagaaccagtcgtcatcaatgccaggatgacgcaagggataggtcgcaaatttggaaatcaccttgttcaaaccggtgtaatcgatcatcatcgctgccggggtggcccagggacagaatttcgcccagacatagtgataacggttaggttcaaccggcagttcaccagtggaaaatttcttagtaaaacccgcgtcattcttttgtgtcggcaatgcacaagcatccccgcgtttcacattttgactcatcaacatcgctccaatctctcatatttgcctctactgtacacggatcgaccttaaatgtcagtaagtaaaaacggaattactcgcaatgagcaattccgtttttgattaattattgataactatcataaagtttctcaaagttcacagtaccaagcccagtcgcctggttatacaatttgccaggttggccgacatagtacaggttcgagttgttcgaatcactatccagcaccgtaaatggtgtcttctccggatcttgtgccagtgcgtaaatttgtggattccagaagcccattcgagttcccttaccactgttaataaccgcagtcacaccgttaaattggggtgcaacagcactggtaccacccaccgtcttccaaccagttgccttggtgtagatctggtaaccagtgaagacgtcggcatcagctgagacatcaggatagttccggccatattgggtgccgctgaccagaaccgggttgggactcggctgcatcaaattcgaaaggtattgacgcgcgttaaaggtattaaccccggaaacaccctgctggtaggctggggtatcatacagcttactgatgccaccgccgccagcgctatataacatttgcagtgcactcaagttggtttggaataactttcggtgcttagcgtatgccttgtacatataatcggcaccccaggcccgttccttatcgacggaaatcttcacaccaccgccaagattcttagtaaacggcagcgtggtaccgccagtcgaagtaacccatggattgtctgatggaaaatcagcgtaagtgctgtaattaggaatgttgattgggccaaacgtgccgccaacgcccatcccgtaagctccggtatcaccagaagcaacgaaggttgaaatgccttggagagccccctgagccatcaacaagctcattgcctgaccatataccggtgtcagcagtttcttctgattcaagtagtgggtcacgtattcatttaagccccaactcattgaaagtgagctggccttattctcatcgaatgccgttgcgtaggcattggtcaacccgacgtcactccagttggcttggtagacgcggacgttggcttgtggtgcaatcgcacccgattgttcaacatccaaggtggtttcaagctgaccagtaggaccagttgagctgtagacgggtgaagcaatcttcttgacgctcaagcgatttggtttcacgtcaagcccctcacccttccagaaggtttcagcgtcactcttcttaaagccggcaaaagtaatgatcccaacagtttgaccttggccttgatagcccttgtcatacagtggttttagattgtagtgattgacaaatttgcttggagaatccttcgggttcatcttacccttgggtgtcttgctcttggctttgctggaaaccaggccgctgccgccctgattgaaggtggtaacccccaagaccgtcagcaccttgtcggccaagttggcaggcatcactggctttttggacgagaattgaaccggattggagtggtaggtcgccgtcttcaggttagttgagaacgccttgttgacatccttggccttgccagtgaccttgatgatcagtccatttgaaaaggtgcttgatttgagatgatatttgctcaaaaacggcttaaattgaccggtcacacttgctggctgaccaaattggtcacggaagtgctgcggcgtatagaaattcttgaagtcaggattacccggtgtgttgacggcgtatatctgattggtaatctgatcttcattctggggcttcaaaacaatgtccaactggacttgcttgttaggggacatggtcttcttggccatgagtttcttaaggatcttctgaatcccataaggatctttcccagccgctttcttctgtgaagctgcttgagtcattggtgctgcggacacaaataatgctaaactggccaaaccgaccagccaatgattgattgtcttcattcttcccaacctctttctaactttcaatatgatagtggtcgaagtacaccggttctgaataatcccccaatcatcaggactgcataatatatgtaaaaaggcgcaatctgcgaggcgccgaaaaacatctccaactattgcgagagtacacgtttcaagtaaatatgtcaagaatgttacagaatcatttggattgggtatttatacacaaagaagcatcctgaaagtttagagactttcgggatgcttctatagaactatagaaagttggaaaattaactgctatggtagctttcaatctagctttgattaccaatgttatattgataaaacgtgcaacgacggccggctgaaagcctgtctagcctacttggcgatcggctgatcccggccatttaagcaaagaaacgagtcattccaaaaacaggaataactcgtttcttcacttaaattctgggatcaaaacgcctcgcgtcccactcttattttggatttgcagcagttaatgaaaggttgctccagaattcattgttggttggtgcaacactgtagcccttaacccgcttgttaactgggctccatgccaaactgaagctttcaggagcgtaagcagcttgactgttcatgtaacgttgccacttcttgtactgttgagcacgatactttggattccaagccttatcattgttcaagctcttcatcaaagcagtgttcttctttgttgcaaagtgacccatgttgaatggtgcgtcgacaccataaatttgagttggtgttggttccgttgaaagtgaccatgcagcaaggaagacatcaatggatgtttgctttggcttttgaagggttgcgtagaaactattcatttccattggcttaccaccggtcatcttgacgttcaaaccaagcttgtgccattgttgcagatagaattgatactcagcttcagtagcagctaagctttgcattgcacccaaatggataaccagctttttaccatttggatcagtccgccacttgccgctcttcttgtagcctgctttatcaagaagtgatttggctttcttcatgttgtacttgaagccagggttcttagcgtcatagacatccttgaatgcaggtggaatcaaggtatttgcttgccatgaaacaccgtttccaaatttcttctcaacggcattaatattcgcagcgtaaatcattgctcgacgaagatccttgttagccatcttggaattcttatccatgacattcaatccggtcttagtgtccatgtggccaacattaaagccaaagtagctgtatcccattgaaggagtaccggcaattccgtagtcactcaacttcttgaacttaggatattgactggatggcataactgagttagcaccaccggcaacgaagtcatatttcttagacttgaaagcagccagaatgttgttagatgaaacaacttgaatggtaatatgtttaacttgtggcttcttgccatagtagtatttgtttggtgaccaactagtggattcaccctgaacaactttgtccagtttatatggtccaacgaaaattgggtttttacgaactttacttgaagcagccaacttggaaattggaatgcctttgtagtattcgtatggttcaacagttgtccagacaaatgagtttccggcatacttcattgaaggtgacatcttactgtaatggataacagtggttcgaccattttgaccatcagggaatgtaatgcctgaaatagtcttggctttccctgcatggtaagcagccatccctttaatggcagcataatcagctgaatactgttgagacgtggtgctcttattaccgatgatttcatatggatattcgacatctttggcggttaccttagcaccatttgaccatttagcatccttacgaagggtaattgtaatggtcttggctttacgatcaatcttctggttggcaaggccgccattcacaatcttatagtccttcgttacattgaacatattgcccataccaccaggtgaaaagacatcttgatcttctgcgttacttgccaaagttggtgctgaaatcccggcaaatggggcatcattaacttcagcaaccttcaaagtactattatttcctgctgtagtcgccttaccagggccactatatgtagctgacattgaaacatgcttgccggcgcctgattcactgctcttaccattagagcaagcagcgagtgtcataactgacagcatcgcaattccggctgtgagccatttctttttgctcatgaaacatccctccaaatctatatttgaactacactaccaactaaacctcacctcaatatgcaaaaaccgcatcatctcctttaatgcccaatttttacttttgatcctgaccacgccgttgagcagcgttggtggttcgacgcatgacttggccaatataactgattgacagacacaaaacgataatctcaattgcggcgggcaaccaagtccaccagtactgagtgatattttcagggtcgttggcattggcgatcaaagttcctagtgatggggttcccattggcaggccaaagcccaagaatgacagtccagtttcaacaccaatgttttcagcgaatgacaaagtagtatcaacaatgatcaatgacgaaatgtttggcataatttctctaaaaatgatcttaaaattactggtaccggaagtcttggaagctgcgacgtaatccttttgcgattcagctaacgttcgcgaacggatgagtcgtgaagttcccatccaatagaagatcgacaggatcagcgtcaacgtgatggcattgtaatgtggaataatcgtcacaatcacaataattgtcatcagcattggaataatcatcatgaagtcataaacacgctgcatggccaaatcaaccaagccgccgtagtacccggaaaccagaccccagcagataccaaaagttgatgagatgatcgtcaaaccaatcgcaatcgaaattgagttacgtgagccaacgattaattctttggcaatggaacggccaccagcatcggcacccagccagtaatccggggtaaagggcttattgtagtagcccatgatgttggtttccatcattttgggaacatcaatgaattctgaagcgataatcacaaacagaataaagaatactaataagaagagggaaaccatcgccggtttatcagccttaaactcaccccacatgattttaagccgtgacggggtggcttcttcattggcttctttagttaatttagcgaggtcctctttggaaatggtcgttgcgtcttcaatatctcgtttcatcttcagcaccccctactcaacccgaactcgtgggtcaacgatgctcaagacaatgtctgaaagcaaagttcccagcaagttcaggaagccatatagcagcaccaacgcggtaatgacggtgtaatcccggaagttgatggcgttcaagaataagagccccataccaggataagagaagaccatttcagtaaagatcgacccaccaagcaggccagtgatggagtatccggcaaaagcggcgattggcaacagtgagttacggaagatatggtgacgataaatatccttcatcggcacccctttggaacgagcggtgcggacgtaatcggagtgcttggcatcaatgacttctgaacgcaggtactgaacgatgttgacagttccaaacaacgctcctaaaagcccgggtaaaatgatgtggtcgagccgggacaacaccgtcccgccaagtccgcttgcctgagcggaaactgatccactggttgggaaccagttcaatgcgtaaccaaaaatccaaattccgataactaaaacaacgaagaatggaatcgacattgtgacatatgtatatacacgtaccaaagtgtcttgcagtttgccttcatgatgggcagcgtacatcccaagcggcagaccgatcccgtaagtcaaaaccattgtgaataatgcgagccataaagtattggcaccccgctgttgaatcaaatcaacaactggttcctggtactcataactcatccccagatcgccgtggaacaaatgaacaacccagttccagtattgctggtaccagggatcgtacaatccatggatttccattaaatgatgaatttgagcaggatcagctcgggggttaattgacccggtaaatgggtcaccaggcatggccttggccagcaagaaaaccaaaatactcaagataattaattccggaatcataattaagacccggcgtaaaattgttttccacatcagacgtttacccccttgttctcagactgctgttcaaattccttagctaactcaggcggtaaagccaccgagtgagttggtgagactttgacgagtggaaacgccatgccgtcttgatcgtaataagttttctgctgttcttggtaaattttctcaatctctaaacgatgcttgcggtgctcctctcgatgattcacgttggtttcaggaatcgcagccagcaggcgtttggtataaatgtgcattggattattgtagatatcatcccgggtcccaacctcaacgattcggccgcgggtcatgatggcgatgttcttgcacatgtgacgaacaactcctaaatcatgggagatgaagagataggaaattccaaactgacgttgaattttcttcatgaagttcagcacctgggcttgaacggaaaggtccagggcagataccggttcgtctgcgataatcaattttggatgggtggcgactgctcttgcaacgccaattcgttgtcgctggccgcctgaaaattggtggggatatttgtatagggcatcagcgtccaagccgacaatatccaacaattgaagaacccggagcttttcttcttctttatcgagatgctcaaaattgcgcagtggttccgcgatgacatcttcgattcgtttacggggatttagactcgaaagcgaatcctggaaaatcatttgcacgtcgcggttataatcgagtttgcgccgattttcgcccttcgtgacgtcttttcctttgtacataacggttccggcggttgctttttccaagccgatgattgctttggcggttgttgatttaccggagccagactcaccaaccaggccataggtttcgccagcttcaatatcgaaggtgaccccgtcaaccgctttgacgttatcgacgacgcggttccagaagccgccgcgaatcggataatgaaccttaaggccgttaatttcaattagactcatgaccggcgccctcctttacttggtctgggaaataaaagtctttatagcaggtgcagcggactaagtgattgtcgccaatgtcgtgcatggctggatgggcttcgtgagccgaggctggaatccaaggaatccgcggtgcaaatcgatcgccatcctttggcatccgttgaagtgacggtaccatgcccttaatcacatagagctcatcattttcgttgtcccgctgcggcatcgatctaagcagtgagcgggtataagggtgcttgggctcattaaagatttgagcggcagttccctgttcgacaatttggccggcatacatgacagcaacccggtcggctgtttcggcgacaaccccgagatcatgggtaatcagaataatgccggcgtggttttctctttgaatatctcttaaaacatccaatatttgggcctgaatcgtgacatccaaagcggttgtcggttcgtccgcgatgattaagtcgggcttacaagcgattgcaatcgcaataataattcgttggcgcatcccaccggaaagttgatgtggaaactggtgcgcggtccgttcaggatcttcgatgccaacttggttcagcaattcaatcacccgggcatgacgctgtttttcggtcatcttggtgtgataaaccatcacttcttgaatctgatcttcaattcgttttaatgggttcagagctgacagtgggtcctggaaaatcatgccaattttggctccccgaacctggttatagcccttctcatcaagtttcaataaatcggttccctcaaaatcgatttccccggaaatttgagtttcttccggatcatgcagccccataatggtggttgccaaagtactcttcccacaaccggactcccccacaattgcgagaatttcatcatgctttacttcaaggttgacgtttgaaacggcatcatagtattgaccattaatcttgaatgcggtgctgacatttttgatgctcaagaattggtcagaatttgtatcaaccacgagaatatctccttttggcaatgtatttatgtataaacattaaaaattaatgaacggtatgattgtttaattagaaaacattatattctcattgtattctcatttcaaaccatgttaagtgttttttgtaaatatttgttatttaaggatgaacaaggtgatgagatatgtgtctgaaaccccatttgaaaggcgttaatcggttgttcgcgattctaaaatgattactggattcttttaaaattaagaatcaacggcaacgctcccgctagctgaaagaagagcgcaaaaaagccgagacaacccttaatccagttgtctcggcctacttcttaagactattaactttgtatgaatcccttgattggagaatgtgacagcttctttttaaatgagaggaccaaaactctgtcagtcatcgtctccctgatccctcttctgcaccgctggttttataggaacggccgtacaccattcgctttggaattgcacttcgaagtgattggctagctcttccatgagcagtcttcgcccagtcactgcgcttggtcaccaagcgataaaaagaaataaaggcaaccggtgtcagcatccatgagtaaatcaggttaccttcaaccatgacaaccgtatcccgataattaaagtgatcgctaggctgtctcatcaatcgattggccaaaaaaatcatcaaataagtaatcagcatccctattaagataaccgtgccaactaccatcatggtctttcgagggaacacgaccaaatgataggtcatcacaatggttgccagcaacgagctgaatgtaaacagcatcgagaaaaacggcagaatcataaagatgattaaatcagttttaagctttggtgggattttcttggagaagaaaacccgcttgccgtatcgtttgagacactgcatcccgccttgacaccagcggacacgctgcttgattaagggtttgtattgattgacgccttcttgaggcataaaggtgttggcaagaaacccaccattaaaaccatgcagcaaaccgttgatactaaattccaaatcgtcgagcagtgaattattccatttgatttgggtggccatttccaaggtcatgaactagccgttgccggacgcgatcgcactcccccagcccatgcggataatctgctgtaagaagttgggaacgccaaactcaaattcctgcatcaaagtcagaaagttatgaatgttgctgatcgagatgccggtttgtaataaatcataattggaatgggtaaaaccattgaaaatgttcaacaaaatcttgaagctgggttttgaatcgctgtcgattacgccgacaaccgtctgtttgaagtcgtgggtttgcgttgtaatccactttaggccatcgttgagagctttccccttaccttctctggcatgaggcagtttgcgagtcaaaatgtgcacccggttattgcccacgaatctttgtaatttcacatccgtgccgtcgtctgaaccatcgttaatgataatcaaagtcgtcttacagggaagtggactcattgcccgcaacagccggctaacagtggcttcaatttcattcgcttcattgagtgccggcatcataatatacatatgcttaacttttcgctgaatatcaaccgaataatgggcctcagcatttttatggcaaaaaatattgaagagattgagaatgccaaatcccatggtactaaacaatgagatgaataagaagacccaaatgataacccatatgtccatgtaatcacctccgtgcaaactgatttggcgttgtcatgaatcaagacgaccgccagccgcttaagtaaatcaagcaatcatccccatcaatcaggaacaattgcttgatttacttaagctctgggattaatcacaccattctacaatctggtgttaccatccccagcacggaatgaagtgatgatgacgtttgttataaacgttgatcaagttgacattattattggcgtctggtgtttgctgacctggggtcttagtcttgtagccaaatgggacgtagtcttcagcgactgtgtacacaaactggtttccttgactgtcatactgcggcaagtaacgaaaagtcgttcggtaacaatcaaaatagcttaatgttctaaatcgatatggaaccccattttgatacaacgtcacatgaacccgtggagtgcacttccaaaatggcacgttcttccaggtctttatgacgtgaacataggtgaagcattgcggtttcttctgataaacattggtaagggtaactacgccattactatcgggtgcctgcggcttgttaccatccggatcactcttataaccctccggcactgaagcttcgttgaccgtgtaactgattgcgtgaccgtctttggcaaatttggccaagccgttaaactgagcctgatatgaattagcttcattgagggtaaccgtcttgccggtatccttgccgtccgcgtacaacttagcagtaacagctggtgtggtgacaccatcaggaacatcctgccagacctttttgacagtgagactcgtggtggcgtcggtgtgatcaccggttgcggaacctttacccattgtcagaaccaccgtcttggtgtttgaagtcgtaacgggtgttccggcggcagctgtcgtgatgtcactggccgtaattgaggccgtgtttggcaaatccaattcagtaccgtaaaggctgtattcattatcgttactgatgtcggaatgatacataatattaattgccttatccagtgtgccattccactggaaagtgaatccagaatcagttggggtgatggtgtaatggctggcagcgattgtttggccgccggcattgtcagtcaccgttactgatttaggatcaaaggtttgtgcggttgtattgcccaaagtatcttcaacttggacattgttcaactggcggttattggggttaaccaagacctgccagtttacttgcgccaaagtcccattcggacggacagtttcgttgatgccccaaccatttttggcaagaaaaacgttcactggatagctgggggtaaatgcgcgggtaccggtgactgagaattccaatgacccgtgccggttggtgttgtatttggcccaataagccgcgttactgaacgtaatttgcccagtcgtggcctttggattggcaacaaattggccaaccgtttcgttggtgttgcttgatttgatatcaaatttctctggtgttcgaaatgttgcaccagtcggtaacgtgactgtggcagtatcaccgttattaacagttgtcccgtcagcaatcttaaaatcataatccagtgtgtggaccggaccggcataccactgttgtgaaacagcaggtaacacggtcgcaccgtcttctttggcggacgtggcagacagtccggtaattgtcgaatcaatatcggcagcacttgcactgtcagaaacagcggctgccgaagcaaacgtgcaaagaaagattgcaatgatacttagcagcttaaaatgcgccacaacaaaattatgcagcttatgaaatgaacaactcatcatatattccccctaaatatgaaattttccgattaagtcggtattgcaccgtcattacacattaataatgcctcgcaacccgcgtattcccagtacgttatcggcatatttccccttgtgtaactgcggtatagttaaatcgtaacgctagaatcctatcgtgacaaggtattttgagaaatgaaattaatttctcagtaaaatgtcacaattttttgatatattcaattagttatgtatatcctcataattttagtaagtgactaaaaaggaccaacttttctagtggaaagttggtcctttattacattttgtttattttactatattcatgtgtttaggattgacaacacaactcatgatctttcatgctgatcatttttcgagccactgtcatttttaacttgaaaagtcggcatcagatgtcccattcccagaccacttaaaatggtccatggaacataaaatgcaatctgatatcggctttgcacctccaccagcagaaaaataatggtcaatccaatcatgatggtgtcactcaataggacgccgttacgttcacgattaactttggagtcaatccgataagcaacaaattgcgccagcaacccaatgataaccagcaataacatgaccacttggtttccggtgaccagatttgtcaggccgttaatcatgtgacgtggcatcacttgaaattgatcagtctttttcctggtatttgagtaaaccaagacaggtccatagtccggcttcatcagggtttcgtttttgtcatagaagaaatgtttccaagtgccatgggctttgataccagcgacattagcctttaattgttttgaaaggaccttttcaaatccagcaaaccgctgttcatttgtgagcttctgattatgattatatttttcaagttttagaatcatgttgtaattgtaaacgccgccagtcttggggttggttcccgtcgccagcgtgtattgttcaccaattttggcatctgcaatcggcaccccaaaatagaagcgatcaattcttggctggagttgatttaaagcaaagaaccccaacatgacggcgaggatgccgattcgtggaacccaaaagtcagctctattttctttggtggtctgttcacttaacctgaaccacacaaagcaaacatacccaatgacaaaaaccatcgataatggtcgaatggattgagcgaaaaacaacaggacaataatcaatccgattgtgacccaaggatgccaatcctttaacgaccgatatgccaacaatttgatcagaaaatacatactcaagaacagtgcgagcaaccacgcaggttcagcaccaatcaatgttgtgtaaagataccaggttggcaggaaaaagaacgtcagagcggcaaacatcccgattgtccgattaaagaaatacgtgacaatcgctaaaatcaaaaaagtcgtcaatacactacaggcgatattgaatacctgaacgacctttggcgaattgatcgaaattctaaacagcacgttatacaaattggcaatgtgcaagacatgtggaaaaatactgtccaagtccaggacgccaacatgatacatccacgcccaagaatcctgattagcggcggacccacctaaagcattgtaactatacatatcagatattggattaagtttgaaggcaaataccagaatcagttttggaatcgccatgatgctgataaaagccacaaaccatccggtaaatctgccggcaaaccacttgccaatgtaccacaacaaaacggccgcaatcatactcacaataacactgacagtaagaccgttaacactaggtgtaaaggtcttatagcttgcccgaaaataaccagtgactgttccagccattagccaaacaacgcaaataactgccaaaatggtgatactgaaataagccgctttaatcagcttggactgtttgatcatcatcgttcccccaccccatcttctgttttgccaacaatttgatgatacaccaaaacaaaagcgcgggttgaagaatccaaattcgcccaggccaaattggaaaatcgggttacttatctaccgccgtgaaccgttcattatgatgagccggatgctcaatctcatcattaatcactttggccattgtgccggcagtaatttccgacttgccttcagcgttggtcagcagatcattttgaccaagttcgtaggccgttgcatccccaggtttaaaagtggcacttggcgaaaccgccacccaattgacattgctggtattggtgagcagctgatactctttgaactgctgacggggaatctcaatgaatgattcactattaggcagtttctccaacttttccacaaatcgatgaccatttccggtttccaaactgccggcccccaaaataaagaacagccgcggcttgtcagtgtccttggcaaattcgatcagtcgagcggccaaatcaacgtgtcggtatgcatggctcatgtcgtgcgtggcgtaggcgtctaccaagacgtccaaatcttggacatccacccgttgaatgtcaaaggcatctttgacaaccagcttgactgcgtctggcagcaggtcctttgccttctcagcgttgcgaacaaatcccgttacctcaaacccgcggttgactgcttcttgggtaatcgcactaccggccatgccagtggcaccgatgataccaacttttaatgtcatgttaaaacctccaatgattttgcttcactattttcgattgtttcgaattaattatcggccggctgagagagtcggtcaaccatttggacggtgaacattgaacataaaagaaccgggcattccaacgataggaatacccggttcattaagttaaacgatgaaatcaacacagattgatttcctgattattttgtcaattcaaccgccttaccggcgacatcaatcgtaatcggctcgccatcaattaacttgaagtgggaaccatcctgatcaacgtcgacttcaattaaacgatcacggaagacttgtctaaatgagtagtgtgaccatttcttcggcaggaatggtgcataatgcaacttgccatcgcgaacacgcatgccggcaaagccttggacaacggcaatccagccaccggtcatggccgtaatgtgcaggccgtcaacggtatcgttattgtagttgtccaaatccagccgggcagttcgttcgtaaagttcaaccgctttgtcttcatagtgaagatcggctgccaatacagaataaatcgcaggtgacagacttgactcatgaaccgtgtattgttcatagaagtcaaagttggacttcttctgttctggtgtgaaatcatcaacaaagtcccagattccttgaagcacgtcaccctgcttgatgtaaggtgaacgcaaaatcttgtcccatgaccagttctggttcaatggtaattgatctgcgggaatttctgaaaccggcttgaggtccttgtcgaggaagccgtcgtgttgaacaaagatgttgagatccttgtcataaggcagatacatattgtcgacaatgtcttgccaatgtttcttttcatcttcactgacatttaattgtttggcttgttcgggagaaacttccttgagaatttccaaggtgtattttaacgtccactgagccaacagattggtataccagttgttgtcaacgttgttctcatactcgtcggggccagtcacaccatgaatcatgtaattctggttccgttgactgtagtgaacccgatcggcccagaaacgagaaatctcggtcaaaacttttgagccttcatggagaacatacgacgtatcgccagtgtagcgggtgtaattatagatggcaaaggcgatatcaccatttcggtgaatttcttcaaaagtaatttcccattcgttatgacactcgatcccatcgaaagtcaccattgggaacaaggcgcccttcaacccctgttgcttggcgttatggtacgcaccgtccaattgcttgtaacgatacatcaagaggttgcgggttactttgggatcggtaatgcccaagtagacgggcactgcgaaagcctcggtatcccagtaggtcgcaccaccgtacttctcaccagtgaagcctttcgggccgatgttcaagcgtgaatcttcgccataataggttgagaacagttggaataagttgaaccgaattccttgctgggcttcggtatcaccatcaatgacgatatcggatttgttccagcggtcggcccagacctgctcgtgagcagcgagcaaatcatcgtatgattggccggcaacttggtcacttaattgatgcatggcatcggttaaagcggcttgagtgtcgtaatcccgtgaggtcacaacgatgacgcgtttttcaagttgagcggattcgttgggcgctaaagcaccggagaattcgttgaccacttctttttcaccaggttgagccactttttcagcagtcaagtcagtgacgttgcgcatttccattcctgaagtgaaccgcggcgtcccaaatggattaggggtcgtttcggctaagacgttgcccgaatcagttccctgctcagttgagagcacttcccaaaaacgttcgtcgtagttggcatcctcgttcttaacgtcgccatcgatcgctgaatcgatcacgaggtccactttagttgagccaacattttgaacagtcacccgctgaacggacagttcctgctgggcaacactcaagaaacgttcaaatttgactgccactttggcatcacctttggtcaccgtaaatgagcgggttaacagagcctttttcatatcgagattgagttcgaaatcgctaaactgatctttcgccaagtcaatgacttcaccattaatcttaacgtgcattttaatgaaattgacggcgttgacaactttgccgaagtaatcaggataaccgttcttccaccagccaacccgggtcttgtccggataccagacaccaccgaggtaaatcccgttgagagtgtcaccgctgtaatcttcttcgaagaagccacgcatccccatgtatccatttcccaagctggtcatggattcctggagtcgtttgtcttccgggtcaaagtcgtgggtcacaatattccaaggagcgacttcaaaagttcttttcataagttaacgtcctttctaagctttgtaagtttctttaatgaatccaactgaggctgcaccgagggccatgatgatcccggctaacaggaacatgttaggctgtgcgttacccaataatgggaataagccgaagctggcaagtgaggcaacaatttgtggcaggcagattgaaccgttgaataatccaagataagtccccatatgttcaccagacaaggcgttggtaaccatggttaatgggtaggtattcatcgatgcccaagccattccaactaagatgaatgacagaatcaaaatgtattgagtgtgaatgaagaatacggagataaatccaactgcaccaagggccaaactgattgagtagcccaacttgtggtgattgtttggcattttggccaagacatatgaccagataaccgcagcgattgattgaacggcagctaagacaccgtaccagttaccggcagcttggtagcctgcggaagcggcattagtggtgttccaaacgttgctggcaatcgcaccggctgagtaggtccagaggtattgaaaggcaatccagcagaagaattgaactaaggtaacagtccaaaagactttaggggcctttttcagcaatgaccaccagttaccaccggttgtgttggcttcttcagtaattccgtgatatttggcgtaagtcttaggatcatattcatgaaccttgaaaatcgtcagcaaacttgtcagtaacagaattgcggcaccaacatagaaggaaatgacaactgattggggaacgacacccttttcagccgtgttggcaacaccaaatgcggtaaagatgaacgggaaaatagctgcgatcaccgcaccaccgtttgacaagaaactttgaatcccgtatgcgtaactcttttggtcatcattgaccatatcgccgaccatcatcttaaatggctgcatggcgatgttagacgaaacatccaacagggcaacggttaccgccccaaataccaaggccgtaatcgatgcgtacccgaaaccaaaactccccgagttaggcaacagacacatgacgatgatggcaattaacgttcccagagccaggtaaggcaggcggcggccgccaagcttaggtgcccaggttcgatctgaataataaccaataatcggttgaacgattaaaccggcaagtggtggcaaaataaagaaccaacccaacttgttgggatctgccccaatcgtttggaagatccggctcatctgtgagctctgcagggtaaaggcaatctgcacacccaagaagccaaagttaatcatccaaatggtactggcaggaagtttaggcaaaccagacttcttggttgcagctgcgctactttgttcatccatttcatattcctccaattcaaaatatcatattaataatagcgtttacattttgtattattgcacgttttaatcaatgttgcaaacggttgcatgaaattaattgagcatttttaaaatcggatcggcgaaaatagactggtaccggttactttggcgagatgtcaatctcataaaaatttcttgtggcattttgatacctactacttttagatttgtatttatgagagaaaaaaagttttttgacttttttcactgatatataacggctgtggtctagacctcatgtgtaatatgaaaataagacgtgtaaaactgtgctaacctttcattgcacttcaatcaaaaatgttttatattgaacaagcattcacaagtaacttgatggacacaatttcataaggtggtgagatttacatgttgttaggtagtgttgaagccggtggtacaaagtttgtatgtgctgttggtaacgaagattatcgcatcttggatcggacacaatttccaacgactacgccaaaagagaccttgcaaaagactgttgattatttcaagcagttcaaggatctcaaggcaatctcaatttcttcctttggaccaattgagctccgtaagaactcgcctaagtatgggtacattacaaataccccgaaaaaaggctgggccaatacggattttgtaggtcgaattaaagaagattttgatatcccgattagttggacaaccgatgttaacgggtccgcttatggcgaatacgtcatggcaacgctgttcaacgaaaagatcaattcgctggtctattacacgattggtaccggggttggtgctggtgcaattatcaacggtaacttcgttggcgacatcggacatcctgaaatgggacatgttcgattgaaacgtcatccagacgacctgaatttcaaggggatctgtccttaccatggcgattgtttggaaggcttggtttccggaccaacgttcgaaccaagaaccggtaagaaaggccaagatgttccactttcagaccacacatgggatatcatggcattctacgtagcccaagccgcaattcaagtcactttgatgatgcgtccagccaagattgtctttggcggtggcgttgtcagcgaagaattcttgaagaaggttcgcgagcagtttaatgagttgatgaataactacgttgacgttggcgatctcgataaatacatcgtgatgccattggtcaaggataatggttcagcaaccgtcggggattttgctttagctttgaaagaatacaacaagtaacaacttatttttttgggaagttccacaaacgtttgcggaacgaatgaattttaaaaggagattttttatattatgaaagcactcgtatttactggaaaacaacacatggaaattcaagacattgacaagccagaagtaaagcctaacgaagttcgtgttgacactgcttatgctggtgtttgtggaaccgaccacgccctttataacggccttccaggttcagcagatgctgttcctccaatcgtctttggtcatgaaaactcaggtgtcatttcagaagttggctcagatgttgacggcttcaaagttggcgatcgagtaactgttgaccctaacatctattgtggcaaatgtttctactgccacactggtcgtccagaactttgtgacaacctctcagccgttggtgtaactcgtaatggtggccttgaagaatcctttactgctcctgccacaaacgtttaccctattcctgataacgtttcattgaaagatgcagccgttatcgaacccatctcatgtgccgttcatggtatcgacttgcttaagttaacaccataccaaaaagctttggttatcggtgatggcttcatgggtcaattattcgctcaaattcttcagtcttatggtgtccaccaagttgacttggccggaattatcgacgaaaaattggatttgaaccgtgaaaaattaggtgttaccaacacttacaacaccactcgtgaccagattccttcagattacgacgttgttattgaagccgttggattaccacaaactcaacaacaagctgttgaagctactcgtaagggtgctcaagtattgatgtttggtgttggtaagccagatgctcatttcgaaatgaacacttacgaaatttaccaaaagcaattaactgttcaaggttcattcatcaaccctaacgcattcgaagactcaatcgcccttctccaaagcggtgacttgaacgttgatgccatcatcagcaacgtcttcgacttggacgaagttgaaccattcttgcaaggaaagactaaaggcgtttcaaaggcagttgttaaagtaggtgactagtttgaaaaataatgaggaaaccgccagccaagttctaaatggccggacgatctcgatgtctaaatccattacgtttttcatcatttctttggtgattaactccgccggaaacgtgcttaccttggttaccagcgcccaaatccacccttcctacttgggatcggcttattggaccgccgctgaagccaacctggcagttgcgtttggctggaatctattttggacattcttaattcttggggtcgtgatcacaattttaaatgccatcctggttggacactgggattggcggcgcgcacttggaaatctgatcttcatggttcccttctcagcgttgattcaagtattcgaagacttcttccttggtaagtacccggcattgtttggtggttttccaccagccaagacgccattcatgattggattttatatcctcttgaacttcttgggtgtcgcaatgatcggaactgccatctccatttatcagcgggtcaacctggtactgcaccccgccgatgacttgatgcagattctgcgtttcaagtatttcaaaggaaatgccaacacagcgatgtgggcatcatacattccaccaacactgatggcaatcttggccttcgcaatcactcgtcaattcaccaacttgggaatcggaaccatctttgcgttcttattccaaggcggaattaccgggatcgcggatactaaggtcttccctcacctgaagcatcaagctttggacgtgggaaaagattagagcgcgacgaggcccgggagatgcggtttctaagggtcctttgattaaagtccctgactttgggactttaattaaagggcacttagaagttagcatctgggccgtcgccaagtaggctaggcagggcttcacccggccgtcggagcgtatttcggaagccgaaggaatctcaaaatcggctaacaaacatttgcccaaggtgctttattaaaaatcaaccctggtttttactggaagttccttgggcttgggtttcctcgtaaatgaacgcggttacacaattaatatgaaagaggcaattaaacatggcaattaaagatgatattacaggaattcaacacgttggaattccatccgttgatttggacaaaacaatcgcattttatgaatcacttggctttgaacaagccggcttattccataacggtgagaaccgctgcgcattcatgcgttttggcaacttaaccattgaaacttgggaaggcgatccaactgctcgtaaagctggtgcaatcaaccatatttcactgaatacaccagatgttgaaaaagctttcgctgatgccaaagctcagggattacgcatggtgaatgatgaaattcaatccattccttcattctgggataagggaattaaattcttcaacatccttggccctaacgaagaaacaatcgagttctgccaaatcctgtaggacagagtgtgacgagcaacgggtgatgcggtgtgtaagaccgaaaagatttaaatcctggtcttggatttaaagctttttggtcttacacgttagcattagttgcgtcggaacacgtttcagctagataacagtggttaacaaacggggctggggcaaatgctttttgtcctagccccatttgtgttttataattaaatcattgaatgattccaagaagggaagtactaataatatggctcatatttcttttgatggctcaaaattatcaaagttcgttcacgacaacgaactcggtgaaatgcaggcattagtgaatgctgcggacaatgaattacgcaaaggcactggtgccggcagcgatttccgtgactggctgactctgccaaaggattacgacaaagaagaatttgcccgcatccaggcagctgctaaaaagattcagtcagactccaaagtcttggttgtcatcgggatcggtggttcatacctcggtgccaagatggccgttgacttcttgaatgatactttcttcaattatttgccagatgaccagcgcaaattcccacaagtgatgtttgcaggtaattcattgagctcctcatacgtttatgatctgattaacttgatcggcgaccgtgacttctcagtgaacgtcatctctaaatcaggtacgaccactgaaccttcaattgcatttcgaatcttcaaggaacgtctcatcgccaaatatggtgaagaaggcgctaaagaacggatctacgctacaactgacaaagctcacggtgctttacgcaaagaagctgacgccagtggttatgaaacctttatcatccccgatggtatcggcggccgttactcagtcttgagcccagttggcctgctgccaatcgctgtttccggtgctgacattgaacagttgatgaaaggtgccgcagatgctgccgatgaatacagcgatcctgatttgaccaagaacgaggcttaccagtacgctgcctaccgaaacatcttgtaccgaaaaggcttcaccactgaattattggaaaactacgaaccaaacatgacctacttcgccgaatggtggaagcaattgatgggtgagtccgaaggtaaagaccaaaagggaatttacccatcatctgccaatttcacaaccgacctgcattccctaggtcaatacatccaagaaggcttgcgaaacctcatggaaacggttatcaagttggataagccaaaccacgacgttgacatccctaaagaaaaagacaacttggatggcttaggctatcttgaaggccgcacgatggactatgccaacaccgaagccttccatgcggtagtcctcgcccacacagatggtaacgtgccgaacatggccgttcacatcccggacgaaacaccatacacattgggatatttgatctacttcttcgaggttgcggttgccatttccggttacttaaacggtatcaacccattcaatcaaccaggtgttgaagcatacaagcagaatatgtttgcattacttggcaaacctgggtttgaagaaaagggtaaggaacttaagaagcgcatctaactttcaaaagtccaaaaaatagcagtcctcgacggtaatcgtccaggactgctatttaattacaacaaacaatgtacaactaaattaagtgcacatcatcctcacacgatacgaaacagttgctttgatgttgccacaactaatggtatcgtcatttattccaacgaaaacttgtgtttatcaaacggtgtaattttcacaacagtagataaacacttaacggacaagaatacacctctttcgacaacaacattactgattggagcctcaagattggccgcactaacaaaatgctgattatccttttcagtcattattatcgcttcctttaatttgaattagttttgttctaattcatttttaatataatgtcaagctttttcttaattttgtattaacctcatcgctttttaatgttatagttattccaataaaaaaagaggatgatacttatggaaaaaacaaaaggtatttcaagacaactaataacggcaggatggacgtcttttttttccgaaatcggttcatccacgtttatgttttctgtaagtttgcttttattacatacataccacaatgcaggagtatttaccttggttcaacttttagagccaggcatcattctgttgttcaatccctttattggagtttacgttgatcagcacaaaaagaaaaatattgcattaacaagccagttgggattagttattactttcgtcattctttccgcttggattaataaagcaataaagtcacctctgtttcttgtgtatttaaccatatgcctttttattattctcatatctactcaatcacgaaaagtaagttatcaggcagcagttatctctatgatgcccagaggctcagtaaataaaatggtgtcagtccaacaaacctgtaccctctcagcaacattgattgctccatttattggctcactgttatattcaactctcggttttaaatcctcagtattttttgagggagttacagaaattatcgtcttacttggaatatttttgataaagtttgagctttatgcaaccggtaatcacactttccaaggtacacaaaaaaacatactttctcaactagcctcagggctaacaataatcaaagttcaccggaacttgttattagtagtactactaagctcttttataaacttcttcttcgcagcgataaatatagggttgcccatcaccgtgattgaatctaaaaatatggggtcattctcacttgctgttattgaggttgggttatcaatcgggatgttgagtggtggaattacttcagggttcatgaaaagtgtgaatataaccgttattggctttcgcttagctataattggaatacttgttgttgccatgggcgtatttttccttagtaatgttcttataattatcttaattggaataactaccctttgtttttttgttggtttattgatagtacgtataaatattcctatgagtagttatgtgaaggaatctgttccgctagactatcagggaagagtaaattcaaccgttgacgctttgtcatccttaatgtccccctttggaattatcacgtttggattcctttttgctcatacatggaatcccactatttatctgctaagtggcttattcatattattcataagcataggattttcacacaaaatatcaaaaggagactagtaaccatggaatataaaaatatgtataatttaatttcgaggaacatggatttctttaatgtattagatgttccagtcaactcaacaatgaatgtagagctaaaagcatatatggaacttataatcacagacattttcagtaaaaacaatctacgaaagcatttgcacgggttttcctcccttgttgcaaagctaaatcattatttctttgttccagatgtcagtgcgagatttccacaactttgtgagggagcactgctcagcctatctatctccaatacctcttcgtctaattcgttctttttgtcgaaggttgaagaggatttagaaccatggaaccccattcttttacaattgcaacactttgcaatcttagaatatgttaaaaatgatggtagcgaaattcaacatatttcaaaattaatttgtaaaagctcacttggtctccacacgccacttgaaataagcgattataacgatatctatagtgcaacccatgcggtaatctctggatcaatttatggtaggcgattattatgtaatctatttccaacgagaacaacctatgattactttaaatatttccaacatgcattctttttttcgctcttggatcatcattacgacttagcagtagaaacactgattgccagttgtctactgtttgaattgagtattagcgaccgaaaaactattgagaatgagatcgattatattgatacaaacatttttcaaaaccaaagaataaatcacataacgaggacaaattttaaggactattaccacctattacttgtacgtataatattagaggaagtgagataatgattgctgatcttcaatctgaaattaaggataaattggataaagattacaacttttgggaatatttaaacttaacttactctatttcgattggggtattaattaagcattttgtcaatcaacctgtaaatacggaagaatacttaattctaaccaagttctgcaaattgttctacaacagtggccttatccaacggcttcccaaatgctttctcaaagcaaataccatattcgcagtttatagcataataaattccgactttacgtacacttatccaatgaattcagaaagctttgttcttaatcgagtagaactggacgaactgcaacaacttcagtacagccttctgcaaactctaaatgaaaagccatgtgtttttgttgatccagtatcaatttatcatgattagttccagtgagaaattgacggctgtcagctttcttaccagacttaatcttagattgtttttgttctatattaatttgcttgagtaacagccactgattcggtacgatttcgacccatgaatttcttaattccagaaatcacaaaagttggtaccgcagaaatcaggataatcaacacgtacatcgtcatcgttaatggcgcggttcccatcacattattgaaaaatggcatcaacgtcaccaagattgaggatgtcgccgcaaacccgaccgccaacgttaatcttgaattggaaaacggatttcgatcgaacaacgtattcacacttctggcatcataaacgtgccataactgcccgaataccaatgtcagaaaggcaatcgtctgactttgagcgaccgtatagccctgtgatgctgcccaaatgaaagccagaaagaccattgcgcccatcacgccaccacggaacagaacccgccgcagcatcccatttgccaaaatagattgtttggtatcacggggacgctgctgcatcacatctgattcggcttcatcatagcccagtgcaaacgatggcagtgaatcactgatcatattgacccacagaaccatcaacgctgtcagagttggtgtcacttcggtgatatttccaatggaagaagtaatcaagaagactcccagcaataatgacagcacttcagcaacattggtcgtcagttcatgtctcataaaattcaaaatgttggcaaaaatcgttctgcccgactcaaccgacttctcaatggtggtaaatttatcatccagcaagatcaaatcggcggcatctttggtcacttccgtcccattgattcccatcgcgataccaatatcagcggctttcagtgccggagcatcgttaatgccgtcaccggtcatcccaacaacctgctcatgggcctgcagttgtttaataatccgctgcttgtgttctggcgttaccctggcgtatacccgcgtgtccaacaccacgtctgccagctgttggtcatccatgtcttccaagtcacggccggtaatcacccgggcgtcatcggactcgataattcccagctgtttggcaattgccttggcggtcatcgcgtggtcacctgtgatcatgacaacgttgaccgatgcttgagttaatttgcgaacagacgctttgacttcctcacgcggcggatcaatgatccccaccagcccaagaaaggtcagttcacgttccaattcggcactggatgcgttcaaggcatcttctttggaaatctcccgctgagtaattgagatcgtccgtaaggcatccttggcaaatgccagcatggttttttcaatatttgcggccactgaagcaattggaaccggctgcccatcaatcatggtcgatttggtcaatggcttgatcacatccggcgcgcccttggtcaaactgtagtaccggccattttctttaatcacaacggtcatcatcttccgcgtactgtcaaatgggaggattcggacaatatcgatgtcccgatcacccttatcttccaacagcacgtcgcgtttgacgttatctttagctcccagcacgactaaggaaacatcggttgggttaccaaacggccgccaattttgcttggtatccggtttaatttcagcttcattatttaagacagcgacttctaagaaccgctggtaatctttaggatcgcttggagtgccatcatccctgatgaaatcgccaattggtgtgtaaccatttccttcaacattgtagacttggccatttgccaaaaagcgggtcgcggccatctcatttttagttaaagtccccgtcttatccgaggcaatataggtgattgagcccagcgtttctacgctgctcaacgacttaaccaatcccttttggctggccatcatcttggcaccgatcgttaacacaatcgacagcaccaccggcattgcatcgggaattgaggcaacagcaatggcgatggccgtggctgaaatcccgccaaagctgtccattgaaatactgccgacctgaattaattattttactaagtcatagccaatcgtcacggcgatgataactgcagcgatgatcatcaatttcttactcaacccgtggactgatttttcaatcggtgtcttttggtcgtcaacctgctgcatcagtccagaaatcttacccagttcggttgccatcccagttgccacaaccacaccaattccatttccattgacgaccatcgaaccagagtatcccatgttggtacgatctgccaactcggtatcctcagggagagagacggtacttttttggatggcatcagactccccggtcaaatgagattcgttaatctacagttctgacgtctttagccagcgcaaatcaccttcgataaagtcgccggatttgacactaacgatgtctcccgggactaaatgattggctgccactgacgtccagttgttatcccgaagtattttcatgtggtgctgacgcatatcagaaagcgcgtccagtgatttttgcgcggtccgggtctgatgaaaggtcaaaccgctgttgataatcacaattaagacaatggcaatcgcttcgtacacagaagccatcgcatgcccggaatcaccgctgatgaagaaatcgtaggcggcactagccaatgccagaccaatggcgatgagcaggataatgatcatgggttctttaaagctcttgattaacattttccaagcgggttcgcgttcttctttggctaactcgttgggtccaacttcggcaagctgtcgttgagcttgcgcctcactcagaccatggatccgacttgtatcaagttcttgtaatattgtttctgcttcatgactgtaccattgcatagtgggcctccttgtgggggttcagctgtcgtggtgcattacttataaatatcataacaaattttgccgagtaatttgtgaagtttgtgaggagtttattggaaagtttggggaattttaaggaaaagtaaaagagagtgcaaatgaaggcgctttgatcccagaatataaaggacttactcatttattccaagatcaggaataaatgagtaagtcctttatatggccgggatcagccttcatttgcacgtttccgctaggtaaaatgacaaccaaggaagagtaatcctattaggcaaaaacatcaatactcaacaaacagctgcccgatcctaatccgccttccgagaaaatcgataatacaaataacatcccacgatcacaacaatcactaccaaaatcaccatcagccactgatcgatcatccccagaatctgatcccaagcccgaccggcaaaatggccgatcagaatcaaaatggtgttccaaatcagcgttccggtaatcgtcaggaagcaaaatcgattaaagggatagccggtcatccccgccggaacggaaatcaaactgcggacaaccgggatgcagcgaccaagcaggatcgccttacccccatggttgttaaagtacctggccgctttttcaatatctgccggtttcaaccgcatgattttgccaaatcgcccagacaccagtttttcaatttgttggacgctcaataaacggccaacaccatataaagcgattgccccaatcagtgcgccagccgtggcagccagaatcgacccccaaatggtcatcttgctggtaacggttaaatacccagtgaagaccagcaccagttcagaaggaattggtggaaagatattttcgattgcaattagaaaagcaatgccgaggtagccatactgattaattaattcagtaattgtattttcactcaaattggttcctcatttcgttttgtaagtattcgaattataacatattcttttttacaagacctttggaaccgccctcagaatgccgtataattaaggtaatcaatgaaggaggacgatcatgaaaactgtaaagattggtaatacaaattttgaagcttccgcagttgccttgggaattatgcgcatggctggtatggaaaccgctgacgctgccaagacattggaagccgctgttgatgctggcattaattttattgactcggctgacatctacggtgacggacaatcggaaaccaaattcaaagaagccttgaaagcttctggaatttctcgggataaattatttattcaatccaaaggcgggattattttagatcctgccaggagtcatgatggcctggtatttggccaacggtacgacttctccaagcaacacctgattgactcggtcgacgggattttacaacgaatgggcatcgactatttggattcattcttgctgcaccgtccagatccgttaatggaagcagacgacatcgccgatgcatttgacaccctgcagcgggaaggaaaagttcgtcacttcggtgtatcgaattttaatcctcaacaagttgaaatggtccaatcctggatcagccaacgcttattgattaaccaattgcaattcaacgtggttcattccggaatggtcaaagaaggcatgcacgtcaacatgatcgacgatgccagcatcgtgagagacggcggcattatggaatactcacgtcgaaagaacatgacgatccaagcttggtcaccattcaattatggcttgtttgccggcatgtacatcaacgatccaaagttcaaaaagttaaatgataagttggaagaactgggcaaaaagtacggtgtctcaaagaacgcgattgccacagcgtggatcttaagacatccggcaaaggtccaagtactgctgggaacaatgaatccggaacacattaaggacagcgcagccggagcagatgtcgaactcacaaagcaggagtggtacgacctgttcttcgcggcgggaaatgatttgccataaagatcagagtgcggaccaaaccgggtagcttttgagcatttatttaataatcagagtgcgaaaagacccggttaggacccagagcacaagcaataaaagccaatgatgaacgccttttgttcatcgttggcttttattgcttgtgtggccgggtcctgggtctttgagcacgttttcgctagataaaagtgtaaaataaaaaccttttccaaaaaatttcaaaaaataaaaatattccccaaccatttcaccgtatatataaagtgatggccgcaaagccatctttgctttccccggcaaattgcacacaggtgtgcatactctccttatactcttgccttcatccatgcccttctggtatgtttgaaggcagagcttacatatagaattgaggcatgatcatgagtcaacataaaaaatatcccagaaagtccagaggaaaaagacgcaacaccggcctaaagacaatctttgccttggcaatcatccttgtcggcatgtggctgggggtcggccaacagcctagtaacctcgcttcaatggtcaacaatctgaccagttctttgttccattcgaacaaaagtgtcaaatcagatcaactggcgaagctggattatcattccagtgatcccagctacatctttgtgaaccacaacaaagcacagttggatccaagttcttggaaaaccaataaggtgatttattccgatctggacaactttaatcggaccagcaccggcaatttggcttacttggaacctagaattgtggtttctgacaataaccgggtccgtcagtatgtggagccaaccgcttggcaccaagaattcctcgatggccagccgattatcaatcgcggccatttaattgcctattcgatctccggtggtatcagtgcatccggccagtataatccaaccgacacgtcaggcgaccaaaacaatcccaagaacctattcacccagaccagcttcgccaatccgcgggttcagacgatttttgaaggtaaaatcagagaatccctgcgacgtggaaacaaagtgatcttcttttccaagcctatttttcggggaaatgaattaatggcccgcggcatccatcttgaagcgatttcaacagatcggacactgaacttcaacgtctatttgttcaatgttcagcccggcatccagtttgattatgccactggtcgctcacacgttgatcagaccatgaaagttccagaaccttaggaaatacaaaaagccctgtcaaggcaggacttttttgttaatcgttttatgcccgttgcgcaccatcaatcacaaaatcagcgccgttggcgaattttgattcatcactgccgaggtaaacacacacctcaccaatatcgattggttcgcccatgtgaccgaccgggatcgtcttcgtgagagcttcttcaaagcctttaggaacgatatcagtatcaatccaaccaggatggacattattaacccgaatgttgagcttttgttgggccagggataacgccgtcgcatgagtcagcaaacggctgccacctttacttgcggaataggctgggcttagcggcaatccaactaacccagcgactgaggaaatattgatgattgaaccttttccaccagagtatttcttcatcgccttgatcccatatttctctccaagaaaggtcccggtcaaattcacgtcaataacttgctgccactcttccatagtcaattcatcgagtgggccgttttttccgccaacaccggcattattcacgacaatgtcgaccttgccaaatttagcgattgctttttgaacggtgtcctgccaggatttttcatccgcaacgtcctgctggacgaatagagattgatcatctccaaatctgtcgacagcctgcttgccgccttcaacgttatggttggcagtcagtaccactttggcaccttcgcgaacataacactctgcgattcccaatccaattccggccacgccaccggtaataattgcgactttatcttttaaacgatccattacaacctctcccttcagttttgaatcgtcataagtgtacctgagcaaattcccaatagcaatcaatttgctcgctaattcacatattaattcaagtcgttatcgcttaataatcatggtaaaattatctcaaacatgtccctaactaacctaaggagttaagcgtaatggcaaaaatcaccgacacaatgcgtgaacaatcagaaccactttgggaagccagttttaaccatcccttcatcaagcagctttcaggcggatcacttccccaacaaacatttcgttattacctcaaacaagaccgttattatttgcagaattttgccgtcctccatggcacaattgccgatcaaatggacgatccggatatcaaagaatttctctatgctggagccaaaggctttaatgacagcgaaaaggaagtccggactgaatttttccaagagttgaacatcacccaaaaagagattgatcaaactgagattgcccccaatgcctacagttatgtgacccatatgtaccatgaactcaatgaaggcaccccttctcgcgccgccgcggcattgctgccctgctactggttatataatgagatcggtcagcgattgataaaagcaggttcgccaattaaaatttatcagcaatttattgagacttatgacagccccgcatttaccacggcaactgacaaaatgaaaaccattgtcgaccaacttggtgaggctgccgatgctgaagaacaggaacagatgcagacggcgtttttgcgaagcagctatttcgaactgcacttttgggaaatggcttacaagcatgagcaatggtaaccgcgctttaatactgggaaagaaggtagcataaatgaccatctacatgttccacggctatacgtccaatgccaacgatcattggtttccttggttggaaaatcgagtggaaacagaactccaccgaccatttaaaaaactgaactttccggattccgaccatccggtggaacaggcttgggatcagtattgtgacgcaaatattgacccagcggacggcatgacccttgttggtcacagcctcggctgcattcaagtcctccactaccttgaccagcacgacatccacaacgtcaatgtcttattagtatcaggctttgacgaacccatttggacactgccggaacttgattccttcacggaacatccggtggattattccggaattctgccaaagatccgtaaggtagcggttatttcagctattaatgacgatagtgtaccgtacccgtacacattaacgctagcacggcacctacacgccaagtttgttttgatgccatccggtcaccatttcacagataccggtaaggacaagcagctgccgatcgtttttgaggaactcaagcaactcatcaaataaatacgtgtcctattggcatgcaaatacacagcatactaaaaaatcagcaatcgcaaaaatgcgactgctgatttttttgagctattaacttgattcaaagtgttttttctgactaatttaaaatttccgaaacacgtttggccagcgtccgagtatagtatttttcaccggtcaaatccaaatgaacccgatcactggcataccaacctttatggccacggctggcttgataccagttcaccaaatgcacgtttgaatgcttcttggctgtcttggcgatcatccgattagtcgtgttctgccaatgacgtggcaccctggtattaatccagaaaacctgccgtttcttacccagggtcttcaatactgaattaatatcgtgctgagttggcggtccgttaatccccaagttaatgacgatgtatttggacaaatgaccagtcgccttcaagtggcggacaatccccggcagcgaataaaactggcggccgacagacccactcacagcactgtggtgaaagacccgtttgacatccggtttaacgtcaatcatcaccgaatcaccaatcgcggtgatataggtcttggaggctgttcgtgtctccagcttggtcagcttgtaatgactggcaatcttcttctcgcgtttcgtcaaatgaatcttagcattcaacttggcaatcttggctttcttgatctgcttagcgctgcgggtagccgtcgaatggctgttgttgccctgggacactttgccgacggtaaccatcagcaaacccacaacgataattgccccgaggctcaataataacgatcgattgaccgaatgtttcttcaatgaatgttttggcatcttaacccctctaaaaattcacaacaatatctagcacatcttataacaaagtcatcaataagtacaccttattgtgaatcaatcggcgcaatttttaacaaaggcgccgttttaactgcttcaataaaggcctcatcgtgatctatgataagcattgacggctgcttgcgcaagatcaggtcttggatttgctttcgagtgatcacatcgagatagttcagaggttcatcccaaatataaagattggctggctcacacagcgacctggccaacgagaccttacgtttttgccccatactcaaatccttcaagtcttcattaaatgccgctcgctcaaagcccaattttctcaaggtattcagtaagtcgtttaactcaattccaaactgatcagcgtagttctgaatcgatccattgagatcttcaaagttttgactcaggtatgagattctgaggctggcgggcttattgactgttccgccagcgagcaactctttgtcgcccataatcactttaacgatggtcgttttgcccattccattaggaccaaacaggatcaagcgttggccgcgctttaaatcgaagctcaggggttgattcaaaattgtgccggcttgttggacctgcaagccttccacttgtaggagatatttttgtggtggttgaatattattcaacttcaagggtgcgacttcatcgacatttttcagcaaagactgtttgacctcaatatctttctcagtgcgccgcagcgtatttttggagcgtttcatgaccttggcagctttatggctaacgaatcccttatcgatattagcgtgctggtcactctgtcggcttttctgtttctggccttctgcatgacctgcccaacgttccattgtgttcgcagtggccttcagtcggccaatttccttttgaaggtgctgcttttcggcaagctccgattgattttccctttgatactcggccgcccaagtttcgtaattaccagcaaataattggatttttgcgcgatcaatcgacagcacatgatcgatgacctgatcgataaagtgccggtcgtggctcaccacgataaagccgcgtttgtgctttaaatagtcagcgaccacttctcgaccttcaatatccagatggttggtcggttcatcaatgagttgaaaggtctgatcatcggtaaacatgacagcaagtaacgccttggttcgttcgccgggactcagggtctcaaatggccgctccaagacgctgtcagtcaactgcagtttatccatttcaacttgaattcgccataactcgctgtcatcaagtccggcaatcttcaataagacctgctttgtcagctgagtaggatccggaattctttgtggaaaatagttaaagtcgacgctgctgtttagttctccctggtaggtatactttcccaacagtagtttgagaaaagtagtcttcccccggccgttgcggccaatcaatcccagcttccaactttcatcaatgtttaagttcaactgatcgaaaagattggtcagcatcccggcatacctaaacgataaatttttaatctgaatggttcccataatctcacctcattaaaggttcagatgggtttctgtgcaatataaaagcctgctgtgcacatcggcacgcaggcgattttgatagactaattgggtgttctgacacactaaaagtatcgaacttaaaacccactaaaattgcaaaatcgcgcagaagaacccctgttctgaacagtgattcattatcaaattctgtcttaacgatttgcaatcttcaatgggcttcacttccttttcatttcgaatttctgttaccaatatttttacacacaattcataacttgtccagcaccggtcattttgaacattcatgcccctaattattccctcgaaataaaacgatttaaatatgagaaaaaagctgtattttaaacctgagtacgttacaatgaagttgtaaagaaagcgcaaacaatttgctaatgactactaactataaccactgatttgacaaagaattgcttgcgatttttacaacaattaatagtatgggggcgcgatctcatggatgagaatttaaaaatcactttgatcggtttgttaactttagtgtttggtacaatttttgcatcaatcttggcaagcatcggctttacgaacatgatcctcggcttgtcctcattccttgtcgcagctattattgtcgtcactggtttcagattgacggatcatcatttggcttctaagcattgagagtggtgctttaggcgttttgatcccagaatttaagcggattgggcaattattccttttggaataattgcccaatttgtttaaatggcagggatcagccgtaagcagcacgtttattccaagtaaaagtggcgctcgacaatgaatgatctcaaaaacacccacacccgtcacaaatacttcgtcccttccctaaccgccaacttcgacaaatgatgctcagccacaaatcgacgcacccaagcaggattgaatttactataattcctcaatgcccaaccaatggccttttgaataaaaaactcatcggtgtcaatatcatattcgatggctttggccagcagctcggtatccaacgtctccttttccagcaactgcaaaagaatggcgactcgccgcatccaaaagttgtcgtgctgatagaacaaatcaaagaccgcccgcttttcgtccggatgcaataccacgaaatccccaaacacttttcgccaagtgtcaactgtatcccaccaggatttcacctgaatatacttagttaacgtcttgacgtctttaaaagataatcgtttcacattggcatcagcaacatcaatcgccacgtactggtactcacgctcgtcacggtcatagagttcagcaatttcttccatcattttagcaacaggaacggttttggaagcttggataaaagctttcgaggccgcttttctctgtggtgttttgaggccaagaaattgaaactgattccgcatatatcttgccatgggtgcctgatttgccttgtttgctttcatttcaaacatcaaaataacctcacaattatttaatgacataccgttgattctgaattggctccagatagtcgttcaaacgttcaaacagcatcaccagccaactaaaggccagtaaaaacgccatgatttcaaacgctgtcagcgacaaatagccaaccacctgaaataatatctcgccagccagcaatgctgcagcaatcatccaggagatgtgctgaaaatcggtggaaatatcaggcagcagccagcgaataccaaaaatcagtcctaatatcaggaaaatcaaatagccggccagccgagtatgcagcgaatggatttccaagttgttgggaaaagccccaaccatccccaaatcaatcgccagcaaagtcaataagattcttaacaccagcaactgccggcttttagggaagattcgtttcaaagaagcaaataaataatccaccagggccaacagaattaaccccgaaaaaaatagtgccaggttaaactcccaagaatcaaccgctttgttggtacccaaaaagctgaggttgtgtttccaccaatacaagttctgattactgatcatcgccaaaatgaccccgctgacaatcacggcaataaagatgttggtcaaaaggcgtgaagatagctgaggaacaagactattgatggcttgaatttcaacactggtcatcagcgcaaataatgccgttgaggtcaccaaatcaaagctggcgcccttaaacagtcgaccggcaatccaaaacaatcccgccatcagcatgaagctgatcaacgcaaacgccagggcgaccgttggcaggtttcgccacgaaacggattcgactgccgagccagactgccgtttcaaccggacgaagacgaccataaaactcatcaggccgctgagtgtcgtcaatagtaacaccattgtcgccactgattcactaccgaccagggaaacctgatagatttttcggaccatgaagtagcccaaaaagacgcagctcattacgaaggttaaaatgatcatcccccagcgccgttttttgacttccactggtttaggagtggaaattttcaattcatcagcaccgatacggacctccacgtgctcaccagatttaacgcccaactgtgcttttagcgcgtcaggcaattccaacgtacgtctttcattcaacaagtcttcctccctcaaaaaggttatacttaattgtaacagtttgacgaggagggactctatgtttattgatcaagtgaacgaccatatttccttaaaattaccggcagcgactgatgccaacggcattttggatctcatcaacagcaatcgcatgcagctggcggagtggctgccatgggccaaagggatggtagcagtcagtgacgagcaaaaatttctgcaatacggaatcgaaaaaatggctcatggtgatttttggttcaccattattctggtcgacaatgagccggccggcatgattgacctccatgaattcagccatgaaaatcagcgggcccaaatcggctactggctggctaatcaataccagggaatgggcgtgatgacgctctgcttggcccatgtggaacaaattgccttcactgaactcgggttaaatcgcctggagttaatcgccgatgttaaaaacaacaaaagccgcgccgtagcaacacgacgaggctttcatgaagatggcattttaaaggaatatctcttatacaacggccaattccatgacgtggccatgtattcaaaactcaaatcagaataacttacttggcaaacaagatggttgccagcaaaataacggcagcgattaaaatggtctgcccatggaaaaactgaatcaaatagccgtttaacagcgccccaatgaagaaggagccgatgattgtcacaatgtcaccggcttttttgagtgccttcatatccccctgggcaacaaagtccaagacactttcagataaggtgcggacgttgccggtcatcatcagtggcgtaaacggggcgttcttcatccggcggaattcctgcagctgggaggctgcagccaacgccaacagtccagttgtgaccaaaatggatacacggccggcaatcaaactcacgacgaccaaaattaaaatttcaaacgctaacgtcacccgcttgcgtgtcactgcccgctcactgggataatggtactgaatcacccggatgatggcaacgccaaccgcaaacatcaccaatgacaccaaggcttggccgatgctggcgtaatcgccgcggccaattctcaatccagttaaaattaagtttcccgtctgcaagccggcgaagacgccgccatcctgcagataggtgtacgagtccagcacccctgcggccataaccaatagtgacccgcttagcagtctttcgtatgggccaattggttcaactggttgcttatccatacagctcacccctttttgtaaggtaaattctgtattagtgtacgccaggatggccgatcagactattaaaaacacttgaaagtttaccggaaaacccgtttcatttcctgggcaacaatctgggggttaacgaagtcggttgacggaatgttaaaggccttgatggtcgtatttcccagcaataacggtcgttgttcgacactcgtttgttggtcagacaaagtgatcacgttatagccggtgccttctgaaattagatggcgtttagaattggaacaattaatatgataagcggtggaatcagctgacacatttaagatgccatttttgatgaacatattggcaaaatgcacgtgaccggtgaaaatcgctttgacttggctgccctttaggatagattgcaattgatcgccattttgcaaaatactgtacttcatattttccaagggtgctcccaggagtgggtgatgcataaagatcacggctggtcgattggattcacccagcttctccttcagccagcgcaactgctgctcatccaggtagccgggttccaagtctccgcatttggtatccaaaaagtaaaaatcccagccgttatctgacaaactgtaataatatcggggctgaactggtttatccagatagccggtataaaaggcggacgtgcgatcatgattacccagtaggacttggatcggcacgccaaattgggcttgttccctgtcgaccagcttcttgaattgacgataatctacggcttttccttcatgaatcaggtcaccgctgattacaatcatgtcagggtgaacttgagttgcctcgatgtcatgaaagacctgcatcagcttgagcatcggatcaatctgctggttattcgcaggttgcgcattctgtggtgttaaatgggtgtctgatatttgaacgattcgataatttttcacgatggctgcctccaaggatttgcccctatcatacgtcaactttggcatggaaaacaaaaagcaccccctttattaaggagatgccagaaaaaactatggcgtcataaacttcacgaaatccacaaacagccgataaatgccgccaaaaatactgccgacaaaaccaaaaatccgtttgagcaacgaggttttgtgagtcgcatgtttcacttttttagttggctgcttaatgctagtcgctgccagcattggcaccaccgccgtactggagttatctgccagtttgacgatcgcgttgccaaccagttggcctttggtaatcggcaacgtcgttttggttgctgaataattggtcacatgcgagccatcggtccctttgcgctgccaaatgactgcttcagggtctttaggggtggcggtcaactgatggccgtcaattgagaaagcatgcgactttaaggcgaccttggtgggctgatattgctggttgaccgtcgagatcagcttattcatcgaagtatacagtgtgttactgtcaataattgtggcaatcaagtggcgaccgtcatgccagtacgtcaccgtaatacagaggccggcgttcacggtaaaaccagtcttgagcccatcgacatgagtactcttgtgataaaatgccgagcctggcagcaggcgattagaattaaccaacacttggttaccaaccttcatcgagggctgcttactccattgggtaatggtggggaagatctccagcaccttggcagccaccgtcgaaatggctttggcgctcaccatgttctgagcttttgatgtcgtgtggggaacctggtaatgatacttgctcaaatcggtattgtccaagccggaactgctgacaaaagtggcatctatgccccaggcgtgcgcctgttcgttcatcattttgataaattcagtgttattgccgccaccgactaatttccccaaggcgatcgctgaagggttggacgacgcaatcaatgcggctttgtacaaatcgcggatggtatattccttggaacgcttgatccgaaagccgccaacttcataacttttactcattcgacgaagttggtcgtccaccggcactttttggttccaagtgatttggtgattatcaattgcttttttggtcagataaagggtcatcagcttggacagactggcaattggccgtttggtgctcccattcttttggtagagaacctgcccggtttctgcatccatcacataggcctctttggcctgaaacttttgttgattggctgactttgcggacacactaatggcgctcattgtcaggatcgaaacaagcgtcatcatgaacaaaatgagtttatttaatttttgctggcgagatttggtaaaacttggcaaaccagagtacccccaaaaatagatttcctcagatgaagctatattacctcaaactgactgctaaatggaagcttatccacaatctttacataaattttacggctgcatctttcttgccatttcatcgatgtgtctgcgaacaacctgctctttactccgcatctcccaagtcgcagagtgaatgatgctattggaacgactgacttttgtgtagagtgcccctgggtagaataggaaacgatgggacacgaaaatataatccgcggtgaacagcagatcttctgccaagtccaacgattcgtcaaattgaatttgatgatcacgaataatcgacatcttgaatcctttattccaggtatagccgccaaaatcgccgcctcggcgattgattgaggcatatgcgttggtcttggaaacttcgcggaactgatcaccagtgccgctgcccccacgccagccccagttgtagccaacggccactaaatcaaccgacggatcagccaacccgcgggccatgacttccagatatttcggctccaataaatcatcgccatcgacaaagacaatgatgtcgcctttagcgttatcaatcgcgtaattgcgggcttttgagaccccttcatgcgactgaaaatagtgggtgtggatgcgttggtctttatctgcatatttggccattgtgtctggggtgtggtcagttgaagcatcatctaccaaaatgacctcaaaattttgataagtttggttcaaaatactatccaaagtcttggacaagtatgatcccaagttgtacgccggaatggaaatcgtaattaatggattctcagccaatgtaatcgcctccaagattgctttttggtgagtataaggctgaagttaggccgacgcaaatagtttgctcatgctgaaaaatgagtgtgggaaaatcagcgtttctattctgggagctgctgattttcccactattccgccaagtgatattaagactacaaaaaagtcgggacaaaacggatggttttgtctcgacttttctcttcttaataaactgccctattcgttaaagcagattattcatgttcagcatgtgactttgacttagcattattttgaccatagtaagcattcttaccgtgcttacggtagtaatgcttgtccaacaagtattgtgggacatgggtttcatcacgggttaattgtaaggcgtgataactgatttcagctgaaacttccaataccttggcattgtagaccgctttatcagctgttgggccccaggcaaatggtccgtgttggctgaccaaaacagctggaacggcgtcaggatcaacaccgcgacgttcgaattcatcaacgatcactttaccagtgtttaactcgtatgcttcttcaatctgcttcttagtcaaagcaggggcacatgggatgtcgccatagaaagtgtcggcatgagtggtgctgacagctgggatgtccatcttagctgcagcaaatgacacagcccaaggggaatgggtatgcacaatgccgccaatatttgggaaatgattgtacaagtaagtatgggtcggtgtatcacttgatgggttcatgtccccttcaacaactttaccgtccaaatcaacaaccaccatgtcggatggcttcatcttgtcgtattcaacaccggaaggcttgataacgaataagcccttgtcacggtcgattgcggaaacatttccccaagtgaacgttaccaaaccaagttggggtaaacgcatattagcgtcataaacttcttttttaagatcttctaacattctctcgcacctctagtttttcattttcattgatttaacagcttcggcttctacaggcaaggctgccttgtagttgtcgataaacttgtcataaccttgaacactggcctcttcaggatacaacgttgccgtcgtagagtctttgaagacccggttggcaaggtaatcttccaaagcttcgccattcttacggttaacacagaagagtgccaagacagccattccccaagggccaccctcaccggcattttccataacggcaattggggtattcagggcatcggccaagacttgttgggcaacaaccggggtcttgaagatcccaccctgtgcaaccaaaacattggtcttaatgtgttcttctcgaagcaaaatatccatcccaattttaagtggggcaaaggctgaataaatctgctctttgataaagttggccaagttgagcttgctgtcaggcttgcgaacaaacaatggtcggccttcaggcattctggtaatgttttcgcctgaaagatatgcaaagttgactaatccaccagcatcttgatcacccttgacagattcggcaaacaacgtgccgtagaggtcatccggcttcaattggagacccaatgctttggcaaattcaccaaacaagccaacccaggcgttgatgtctgaagaactgttgttggtatgaaccatggcaaccggtgcaccatctggtgtcgttaccatatcgatatcacgatgaacagccttcattggtgaatcaaggacaaccattgagaaggctgacgtaccggcagaaatgttaccagtccgcttcttgacactgttggtagcaaccattccagtacccgcatcaccttctggtggcgcaatcaatgagccgccttgaagggtgccgctttggtcaagcaatttggcaccttcatcagtcagctcaccggctttcttgccggcaggtaaaacagttggcaaaatgtcgagtagattccacggatatttcttaacgtcaggtaatgaactaaacttgtcagccatttccttattgtagttgacggttgattcgtcaattgggaatatccctgaagcatccccaactccaatgaccttttcgccagataacttccaggtaacgtatcctgcaagagtggtgatgaagtcaacatctttaacgtgcttttcgtcatttaaaatagcttggtataaatgagcgatactccaccgttctggaatgttgaagttgaacagcttggtcaatgcttcggcagcgtcgccggtaatgttgttccgccaagttctaaacggtaccaggatttcatcattcttatcaaatgccatgtaaccatgcatcatggcactgacaccaatcgaaccaattttcttgatatcaaccccgaatttgtcatgcacttctaatgccaggtttgcataactggtctgaatgccatcccaaactttttcaagtgggtaagtccagatgccgttatctaattcgttctcccaaagataatcgcctgaagcaattgtttggaaatcgtcagaaaccagaacagctttgattcgagttgatcccagttcaattcccaacgaaatgtttccgcttacaatttcatttcgtactcgactttcgtccatcgttttttcctccaacgtagctacgtttagttttcgtttactctctcattgtaaaatattcgtacgtataaatcaattcttttctaaatttatgcaataaatatttactaaaaagaaaaagcttagactaacatgtccaagccgtcttcatcgataattttaacctgggatcctttagcttcaatcaaccctttgctcgtgagctgcttgaaggttcgactgatcgtttccggggtcgtccctaaataggtcgcaatatctttcttctttaatggaagtttaaatggattttcatccagggctgcaccggtttcaaccaggtacttagccagtttgccggccatatccgccgtagacgaaagcgtcttttcttcctggaggctattaatctgctgactcatagttgccagcagactcaccgagagttggggactcttctggagtaatttttgaaaggccccctgctcaatttgacagacgttggagtccaccaaggcggtcgccgtcacgtttctctgatcgccgttaaacaaagccgcctccccatcaaagtcacccggttgaaggactttcaacaattgttccttaccgttggcggccacttgagaaattttaacctggcctgcttcgaggatcatgaagtgaccgactttgtcgccggccagatagataatggttcccttgggataattatgctggaccaccagtttggcaacctcagtcttttgctcttccggtagcgagtgaaacatcggtactaaattaacgcattctaatgcttgctgtaaatccatcgtcatgacctcactattccttgattaactgttccagccattgtttcgtacccgcatcttcagcaatattgggatcaaaatgaatgggcgtgaaaatagcagcaactttttgccaatcaattttcccatcactcagtaaatttgtctgcagtgtcgtatacggttcgtcggtaatcattttctccattgccggattctcatgaaccatttcaatcatggtatttcccgccagttcggctgagacaatttcctgcagttgactatcggaaaccggattggtcaccaagatccgattagccaatggaaccgccggaatttctcgctggaggaagtgctgaatctccggccagttgttggtcacaattcgataaaattgatatgggactttgttgccaatacttcgaagcgtgtcccgcaaaatctggttcaattgccaagtctgatcaatcggcgtcaccaccaacaactcctgaataaatcgttgaaccgtttctttatcaacacccgtcaatcgtttcttcagcgtcagcccataacggaccaaaacaaaatcttgaaattggtccgggtgaattatccgtcccgccggttgatgcattcgtttgcgaatcgctttaatttgcttcattttactggatctggcaaatctgccttgtttaaccattttgttcaccactcacttttcttgttaatttcattataccggcgaacctcaaattcgcctaatgattatataaaagttccgccattcaccactccactcaaattaattggcatatacaggtattcattcgccatttacacaatcattacattcatttaatgggaaacagtctcttttaactttaacgtgtttgtaacatgctgcctcatttactgaattaccacggacgttcattgtcatacttttgtcttatttgtaatcgcggttgacggttagttcagatctgatattatacttgcgtgattgattgttccacgttcacattactaatcaatcatcttccaaaattcactcaccatttccaagttgtgttccggaacacacacattaacattcaagcaatcattttatcaattttggaagtcgggctttcatttcaatcgtgaacgtaattctagacacagtaatctaaaaggtggttattacaatcaaaaagagtctattaacattatccgtcgttgctggtttcttaggtttcaccggagtggctgccagcgcaagtacttacaccgttaaatccggcgacactttggctgaaattgctgctaagcacaactccagcgttgacacgcttgttaagcaaaacaaaattgctgacaagaacttgatcatggtcggtcaaaaacttgaaattggcaaatctgctaagaaaacgaccgttaagaaagttaacaaaaaacatttcaagacatcaacttcaatcaaaaagggttccgctcatgcagctgtcgtcacttcccaatcagggtcggacaactcaaccaatgacgcaaccagcagtgcaaccacaacaccggcagctttccaatcacaaggtgtgatttaccaagatggtaaaaagtggacgtactacacaggcgcagcattcgcggatggcaccaccaatcatggcggctacgatgcagacggctacttaatcgtggcagccccatcagacgtcccattcggcacccatgtccaaacaccacttggtgaaggcgtggtccatgaccgcgggacagcgatcgtgggaaatcattatgacttggtaatgccatagagtgcgacgagacccgggttgaccccggtatgtaaagcaaggattgtattgatgaacgcattttgttcatcgatacaatccttgttttacatgttaggggtcagggtcatcggagcacatttcaatcagagtgcgacgagggctgggtgacccgttttctaagtgagctttggttaaaaccctgaacttgggttttgaccaaagcttacttagaagttagggtcaggccctcggagcacgtttccactagataacagaaaaacatcatcaaacaacaaccaaaagtaccagcaaagcctccaaaaagaaggcccagctggtattttttcatccacatacctatttacgtttttccaaagatcacccaacaaccaacctcccccaccaaaaatcgcctaaactcaaaacataggaggtcttcaaaatgaaatctaaccctaaccaaagccatcaacttctgcacgccagcttggcattgctgtgcctcgcactcttaacagtgggcatctgggcaacagtcctcctggtcttaaccaccaagatcaacttggcgttaatcctggtcctaggtggcggctgggtggttcttggctgtactatcttcggcatcgtcattctctggcggctcattcaacggccccaacaagtggtgcttgctgttcatcgtttgcggtggctgcttggcattatcactgtaagcatcgccaccaccagtctgacgtttgcctacatctgggccaagtccggcgacgcccctggattaatctttattggactgttcctcagtgccatgccatttgcttgctgggtcctggtaagtgtttggcagacaacattaacatcaccaaagtaactagtcacgtcacgcacgttgtttgccggaaaagatcgtgtgtgacgtgtttaaaatattcctttaagcgatttaatcccgtctagattcgacgacgccaaattccgccatttccagataattcttaacggtggcaatcaggtcgtccatatcctcaatccgcttcatttcaggatgctcctcaagttctttttggacatccgctgaaatcgtccccagaaccagcgtcaaatatttttttacttggcctttatccagatctttgcgaattgtcatcttatcaactacgcgggtcacgacggtatcttctacttctgcctgccatttggtgaaaatcgcgaatacttcctgacgcaccttttggggaatcaaattatcctgcgcatacacgcgggtcaacaaggcaaattcgtttggaaactgatgagagagctccgtcttatatttggtcgcattaataatcatggtcaccaaatcgtccgaatcggtccacacactcaaatcgaccgtctcaaccaacgtcgccatcgcctgcttaacggcagctacataaagtttctttttattatcaaaatatctaaaaaccgatcctttggaaacaccggccgcttcagcaatcttatcggtactggcattaaaaccgtccttgccaaactggaccacagcggcgttcaaaattgcgtgttcttttttcggatcacgtggcagtcttttcgccatattagtcctccttaactttccaaatcacggttcttgtaaccaacaaagccaaccattatcaaaatggcagcgattaccagcatccaaatcaaaggcgtggtattaatcgcgtcgatcgggacttttttcgtccaataaaacggtgaaattttgagcgtccattttggcagatccatcaggttaccaaagtaggtaatgagaaatgaaaggcccaaataagcccaaaccagtgtccgcagtcgtgggtaaacaccaatcaagcccaccatcaaggccataaacaatgcgattgacggcaaattagcgacgaacgtttgccagaagtatttaaaagcaattggatgagtcatcacaacatttccggctgccatggcacttattaaggctacgaaaagcaggagtgctgccaaaatcaagccgaaggccacataaactcccagcagataaggtctgctttgcggcttggtcatgaccatctggagataaccccgacgttcttcggttatcaggtgattaacaaccatcacaccagcaatcactgccagcaagctaaagatgattcccagcaaaccgacaaacgacaatacttgggtctgctcaatatggcggatgccactttgacccaagactttttgaatggtcggtgaggtgttgaaaattttactgatactattgaagaccgatccatagctagcgcccaaaacggccatgccaacaatccagaatatcgtcgacgatttttgattccaaaccagtaaggttgccggtccacggaggaaatggctcttttcactgcccggattgacgtggatgaccccggcatcgatgtcccggttgctgtttaaggcaactgcagcagcaaacgccaggattcccaaggccaaaagcatcacgaccggccaccaattattgttggtgtaaatttcagtcttttcgagccagcctagtggtgaaatccaggtgtaatcaggattggagacgtcagccatcattctaatgagataagcaattcccaagaaggcgtaattgtacatcgaaacgttgtggctgtcagcaaccagctgagcgaatatcaaggcaatcatgccaaacgcccaaccaacagcggcaatggcaactgcggacagccaagtgccgttagtatcactccccggcatgtcggcaatcattgtgccgatcccggtaatcagggcaaacaagccattggcaatcagtaattccaaagccgcagccagtaatggcgccaaacgaccaaccggatgacccccgaggaccatttccgtcaagccggattcctcttgacctcgactggcgctgacagctaatgaatagttgaagataatgataaacagtccccagaataccgccatttcagatgcgaaaatcaaggctgtggtcagctgaccgtctggaacgctgccgatcaaagcgaccatcgccttggaccgcaaagtggatccaatggcggcaatttgtttgctggtgccatagatgccttcaaacttagcagccactgccacgaaaacgccgaccagcgcggccagccaaatcgtgattttaagccagtcccgtttcaaattggcctttaataacgtcaaagtttgtgtgtattgtgccatcttactcacctactttttgaccggcatctgaatgatagtaacgtaggaatagatcttccaaagttggcggtgtcgtcttcaactgaacgattgagctcttggtcagcagatccatcacagcgccgatttcatcggaatcaaccgtaaactcggcaatggtatgctgatcatttttaaagttcaattgatgaacacctttagctttgtccagcccgtccattggtgaagcagttgtgatcgccaccacgtttcgggttaagtgctgcatcgactccagtgaaccggtttcgatcactttgccttctcgaatgatggcaatcgtatcgcacatcttttcgacttcagataagatatgactcgacaataagacactcttaccatgatctttgagttcggctacccgctgctggaaaatgagctcgttcaacggatccagcccagaggtcggttcatcgaaaatatagaggtcaacatcggttgaaaatgccgcgattaaggcgaccttctggcggtttccttttgagtaggttcgattcttcttgctggtatccagcttgaattctttgattaattcgtccgttttggcagtatgggtttgcccagacctatgcagcagcatatcaatcgtttggccgccggtcaggttcggccacagataaacatcccctggtacatatgccaggttcttgtgaattttgaccgaatctttccaagcatcttcaccaaagaccgtcgcagatccgcccgattccttgatgagccccaaaatcacccgaattgttgtcgacttaccagcaccgttgggtccaataaaccccaatacttcaccacgatgaagttgaagattcacgtctgttaatgcctgcaccttgccaaatgattttttaagcccctgtacatctaagattaattgattttccatgatgcccactcctttcgagcagccaaagccttgatatttcaaattcgccttaagtctatcataaatgactggggagtcaataaccatgcagtcattattagacaataaaaaatcaggagtcgaaaactcctgataaatctggtttcgggctacttttgaatatccggaaccttttcaatttcattgccataacggccgtttggattatgccaggtaaaatcgtcataccaaagatcacgcttattttcatccaactgattaattcgttgaacatcttcatcgctcagcttaaagtcaaaaatatcactattttcaacgattcgcttttcatggactgacttcacaaccgtgacaatgtctcgctgccattcccaccggagaataatttgggcagcggaacgactgtactttttggctaattcgtcgataatcgggttcttcaatgctttaccagcaccaagtggtgaccaggcttcaagttggatgccatggctgctgtcaaagttcaaaatgtctttttcttgttgggtcggattaaattccatttggttgattgctgggacaatttcagattcttccagcaatttgctcatacggtcattatcgaagttggataccccaatggcccgaacttttccttctttatagaggcgttcaagtgcatgataactttccaaataagtggcatcaaccggccagtgaatcagatataaatcaacataatcgaggcccaagtcagacagttgtttgtccaataccttggaaaccttgtcatagtcgccctgttcaccgttatacagcttggtggtgacgaacatgtcctcacgctttaatccagcctgttgcatcccttcacgaataccttcaccggtaccgggttcattcccatattcacgtgcggtatcaattgcccgatacccatgcttgatagctgtaatgactgcgtctcgtgaatcgttgttactggttttccaaacgccgagacctaagcgtggcatctcgacaccattatttaatttaattgttgattgtaatccgtccaagaacaaacatctccaatctttaatgttggtactcctttagcataccataccgcccgcggccaatgaaaatgatttgttgaagggaaaacacgacgacacattaattggcttgtggacaattcaactgtatactttcattatagaaaacaagggggacaggttatgattagaggaagtattgatcgttttaaaagcatctattttaagaaagccgttgaatatctgatcgtcatggcaatcgtctggatcatcgtgttgatctatgccaagaatttcatggacaccggcagtctagtccatcactttacgaatggaattgataaaacagcacccagcgaaactaattttttgccattatttttctggaacttcgctggtgccgcggttgtcatcgccttgggtgtgattgcactaccgatttattggtattatgttttgcaaaatgcctatagtgtcggtttggtgatttcgatcgttggtagtcctttcctgatgtttgtcggtggtgtcctgccacacggaatttttgaaatttctgcccaggtgattgccgctgcgatcagtgcacggttggcatggtatgggatgaataaattcttaaaacgtaaacgcgaggatattaaatatattgagttgctgaagcagacgctgacggatacactggtcctggtgatgccgctgctgtttgtagctgcgatcgtggaaacttatattacgccgatttttattaagatgattatgccctgagtaggggacgaggcgttttcatcccagaatttaagcgacgaaacgagttattcctgtttctggaatgactcgtttcgtcgcttaaatggccgggatcagccggttgctgcacgtttaggctcgatagcagtggtgcttaagagaggctacagctttgaatgaacttattggagttacgcctcccttctgccttatacacatgctccgacggccggctgaaagcctgcctagccccgtgggcgacacccctgacccctgctacacaagtcaaaaggaccagtaatgaacaaaaaccgttcatcactggtcctttttttgactccactaataccttttcaaagaggctacagggtttgtggcacttattttattttctgctcccttctgcttttgagctatgctccgacgacccagggccctaatgtacaagaaaaaacggccaacgatgaacaaagcccgttcatcattgaccgtttctccttgtacgccgggtcctaaccgggtctcgtcgcacacttctattgaaattgcattccgccatccacgatcagcgtttgtccggtaacataatttgaatccttacctgccaagaatgatacagctgctgccacatcttccggctccgacaaacgtttgagggcaatatcctttgcgaatgtctgcatgccccactcatcgtccttgccggcgttcttaccgacttgatgcgcgatatcaaacatcattggtgtttttacgattcctggtgcataagcatttgcggtgatgccttcttctgccaagtcacgggcagccacctgggtgatgcctcgaaccgcaaacttggtgcctgagtacaatgccaagtttggattaccgacaacgccagcttgtgaagtagcgttgataatcttgccgccatggcctaatttcttaaatgcttgatgtgcagcttggatgccccacagaacaccacctacgttgacaccatacacgagtttaaattgatcgggggtaatcgtatcgattggtgtcgttggccccagaccagcgttattgacgattacgttgaagtcgccgaattcatctacggctttgtttacagcagcgatgactgaatcacggtcggaaacgtcggccttgatgccaatcgcttcagaaccatctggtgaaagcttcttggctaccttgttggcattgtcgatgttcaaatcaacaacggcaacattgaatccatcatcgtgaagacgagtcgcgatggcttcaccaattccctgacctgctccagtaactaatgcaacttgctttgccataattgttacctccatttgtgaaaatcatttgtgcatatccagtatgcgctttcattgtaactgattatgaaaggcgatgataggaaaatgtcgtctaaatttcaaaaaattggctgccgattccattcagcaaaaaaggcttctcccactcacagcaggaaaagcctagttagtctcagtcaaatcaactgagaaatgatcccgaatccaatacgtcatgatccatgaaataaacaggaagacgatcacgaccagatacggcaggtgataacttgcatccaacaacgcgccggaaacaatcggcccaacgatgttgccgacactggtcaaagacatgttaaccccattgattaaaccttgcttagtggcacttgctttggtcagcagagtcgtaattgccgggcgaatcaagtcatacgctgtgaacacgattaaagttgcaatgatcacttctaatttggagtgcgccagaataatccagccggtgcccagaaacgagagtaagaagcagtaacgaatcaggcgtttttcagtcagccaaacaaccagcctgtcgaacagcaacgcttgaaatgtcagcgaggtcagtccgtttaacgtcaataccaaagcgatattgcccattgtgaagccaaaaacttcgttgacatacagactataaatactttcgaagccaactaatccaaatgaagaaattaaaatcagaagaaacagtagtcccatcggccctgcaaacagcttctttgcctgcgtccaagacgcccgcttgggtggcctgctttgcgccggaacttgatggttggcagcaatcttctcaatttctttttcgttcggcagcattaaccacaatgacagcatactcaagaaacctaatccggctgcgaaccagaatggtgttttataatcaaacttggccagaataccaccaatcccgggtcccagaatcaagccgccactgaaggccgcggacaacaagccaatcactcgggctcgctgccgtggcgtggtcaagtcggcagccaatgcgttggtggtcggtaccaccatggcggcagacaggcccccgatcgtccgggaaatatcaaacatccacaaccagttggtcatggcaaagagaatttctgaaaccatatataatagcaggccggcaaccagaattggtttgcgaccaattttatccgagatttgaccaacgattggggaggcaaccaactgtgcgattgcaaacagcgagttcatgatccccatatcggtggcggataaatgcagttcgttcttaataaatggcatgaccgggaagatcagactcatcccaatacagaccagaaagtttccaaatatcaggacaattatcgcgtttctaacttttttcgacaattgatagccccctttcgattttcgtgaaaagcataaaagtaagtataacgctataaaccgcgttatgtctaccggattgattcccttattcaaaagtcatcggatggtaattgtcgtcattcttttgtaaacttaacacacgacatatcgtatttcccgttaaggaggcgaatcacatgaatgaatcaaatcatttacccgcccaaatcaaaaccgtttggcgaatctcggccatcttcaacaccctgttgtcagccggcgtcggggtcgctggggtcatcattcactattttttcaactatcaatggctactgtacgctgccggattcttttttatcgttgccgtcattgatttcgttgtcgaaatgagcctggttccgtatcgttattctttttggctgtacaccctgtccgatgatgccgtcgaactgcggtccggatttatctttcgcaagttagtctcgattcccatcgcccgagtccaggacgtgaccctttctgccgggccgattttacagtcgcaaaagcttcaagaagtccgcatcaccacggcctcaacgtcccacaaaattgatggtgtcgaaccggaagttggcgaacaactccggaaacaaattatgaatttggcggtggaggtgcggaacaatgacgtctaatcgacagcatctcaacccattgtcaatcatctactttatcttccagcattcttgggatacactgcttctgctgatcattggatccgggccgattacccgctggtcaacagccattgggatcgcgccactcctaggattcagcgttcttatcctactcatcattctttggcataccgttcgttacctgtgctttacatttgaaatcgactcggacatgctgacgattaacagcggcatcttcgtcaaacgacacacacacattccatacacccggattcaaacaattcagcacacccagtggttctttttggtcccatttcatctggaaaagcttcaaattgaaacggctggtcacgatgagcacggaccggaagcggttttgccattagttaacgaacgagtcagagcagaaattgaacgtcagcgcaccggaaacgccgaaccagcgcctgcagctgaacacttaaccgaacagttaaaaccaagccctgaacatgccgactacgaaatcaacccgcatgaactaaacatcttcgcactgacctcactgggggtctttccgattatcggggccggctttgcggtctacggcaaaattcaagaagccattccgcaaaagttaattgattccttgaccgcgaaattaattcatcagtctgcaatcattctgggcgccattggcttgttaattgtgattatcagtattgccggttcctatttaaccatcgtccaaaaatactatcggtttcgcctgaattccacaaacgaccagcttaaaactgagcagggtctattccaacgcaattcagttactattccgattgcccggatccaagcactccgaattaaacaaaacgtgattcgccagtggtgtcacatttcaaccgtccaagcactggcagcgtcatcggctggggatgatgagaaaagcaatgatttaatgatcttacccgtggtgaaaaccgatcgtgtatttgacaccctgcatcccttcgtcagctgggcgcccactcacttcagccaattggatcatttagccaaacgaacttactggtatttcatccgcaatgccactttgatcagcctggtgatcgtcctgccttgtctatatctctttaaattgtggggattactgagcctgccggtggttgtcatcgcggctttgatgggctggtattcagctgccaataccggctggaagattgtcaacgaccagctgattctccaagacggccatttcttcacccggtcgcaatacgtgattcctcacaagaatatccagtcatttttatttgtccaatcaatttggatgacccataccaaattagcgcatatcagggtcaacgtccgccatggcaatggcaaccaactgtttgaaattcgctatttacccgaagcagtcggccaacaaatttttgagtggttaaaaattagatgatgaatgccattatcagggttatactattaactaatgaaaattaggaggtatgacagtctatgagagaattgaacataggtggttcaacagtacccgcaattggtttgggaacctggcacatgggagacagtgccagcacccgggctgatgaaattaaagcaattcaagatggtattgctgccggtgccagagtaatcgacaccactgaaatgtacggaaacggccgcagcgaacgcttagttggcgaggccatcaaggacatgcagcatgatgatttgtttatcatcgacaaagtcctgccgtcaaatgcctcagcttccagaatggaacacagcctggataccagcctgaaattagttgggaccggctattttgatttatacctgtatcattggcgtggtgccgttcctttgagtgaaaccatcgagacgctccagcaattgcagcaaaaaggaaaaattaagcattggggagtttcaaacttcgacatttctgatatggaagaactgatggatttgccgaatgccgatcaggttgccgccaatgaagatctgtacaatctcggcagccggggcattgaatacaccctactgccttggatgagacaacggcatattccactgattgcctacacacctgttgcagctggtgatgcccgaggtcgtttgactaatgacccggtcgtcaaacaaattgccgacaaccattcggcaactgcctggcaaattattttggcttgggcaatccgcgatggcaataccttggccatccctcaatcgggtgaccccaagcatgcggtcgataatgttaaagctgcagatattacgttaactgataatgagttggctcaattggatgttgaatttccaaagccaacgagtaagcaaccgttggacatgagatagagtgcggagccgagcggttagtaaccggagcctaagctgactttggacaaaatcgcttttggtgttgtccaaagttggcttaggtgcaggttgctgcttggcggagcacattttgattagagtgcggagagcaacgttttgacacagagagctaagatcgctttgattgaaatcccgggtttggatttgaatcaaagtggcttagatcgcagtgtcagttgctcgcagcacatttcaaccacagtgccacgtgggctgggtgacccgcacgtttcagttaactttcgagcaactcccccaataatgggttacaatgcaattagacagagtcaaggttcggttgcattgttttttgaattcttttgtaaccgcttacttcaatcagaggagctgattattatccgttatgttgatatttccagtggtaaagattatttgaaccggccgatcatcaccgacagtctctcaaaattcttcatcaccagtccaaaatttactgaaccgattttctacttttccaggcccccacaggcatcggtggtcattgggttgaatcaagatgtttattccgaggttaatttaaactttatccgtgatcaaaaaattcaactctccagacggttcgccggtggcggtgcagtgtttgttgatccgggaaatttgacgtacgtctttattgacaacgatgacggctcaaattatggtgatttcaaacgctatgcccaaccagtgatttcaaccctgaagaaattgggtgtcgacgccaaaatgaccggccgaaatgatttaaccgtggacggcaaaaaaatctcaggaatgtcggcattaaaaatcggggatcgctttttatgcggcggtactctaatggtagatgttgacctggccaaagcggccaaagcccttaccccgccgaaagtaaaactgcaatccaaaggcatcaaatctgtccatagtcgggtcaccaacattcggcagtattttgatccgaaatacaaaaatatcacctttgaagaactggaaaaacgtatcctgctgaccgtctttagagtcaccgatattcgtgatgtaccaacctatacgatgactgatgatgattggaaggatgtcttaaaaatcgctgatcaagcctataccggtgacgacttcgtcatgggcaccaaacccaatgatgattacttccgcggtcgtcattttgacggcgtgggaactgttgaaatcagtttctcagtcaaaaacgatgtcgtgactcacgcaaaaatctatggtgatttcaacaatcccaatggtgatttggcagccattgaaaatcacattaccaacgtgccatttgccaaggacagcttggaagaggcctttagaatcagcaatcttgaagctaacatcggcaaagtaacgccacctgacatggcagatttaatgttaaaagagaagtacgatcttaaataatgaaaggatgattatcatggcagataaagcagatgattccaaatacttatgggaagaaaaaaccagtgaaggacacactcgaatcggcttaaacgacttggcccgcggtgaaatcggccaggttaccttcgccgaatttccggaaaaaatgactgaattaagtgccggcgatccaatgctgtcatttgaaggtgccaaagccgtgactgaaatccattcaccaatgagtggcaaagttgccaaagtgaactcagatttaattgagcatcccgaacttttgaacgaggataatcgggacaaaacttggattgtggagcttttttaaaaataatcggtttatcgttttagtttaatagggagttggaaatagccattgtgatggggtattccgctcttttttattttaacccggacgtgctatacttttctatgtaatcgttaacaggggaatttttttgaagggactgagaatcattatttttgtcgacttatctgatccaaattcacaactgcatttgcgcgacccgggagtcagcggcagtctctcgacgttttttatcacttcgcctaaatttaccgacacgatttttcatttttcgcaaccggcggccgcatcagttgttctgggcgtcaatcaggacgcatactccgaagttaatttagattatattaagacccacgatattcgtttggcacgtcgtggtgccggtggcggtgcggtttacgttgatccgggtaatttgacatatgcctttatcgataacgatgatggcaggaattacctcaacttcaaaaaatatgcgacaccagccattcatgtactgcacaagctcggggtggacgcggaaatgaccggtcgaaatgacctcacagtcgacggcaaaaagttttcggggatgtcatcgcttaaaatcggcaaccgattctcgtgtggcggaacactgatgatagacgtcgatctggatcaggctgcaaaagcactaaccccacccaaaaccaagttggcctccaaaggaatcaagtcggttcacagccgggttaccaacattcgtcagtatttcctaccacaatatcgccaaatcacttttgctgaaattcgccggctgcttctcgaagaagtctttcaaacgactgacttggcaactattcccacctatacaatgtctgaagcggattggcagcaggttgaactaattgctcagaacaagttcactgatccggatttcattatgggaaccaaacgcgatgatgatttcttccatgggaatcactttgatggtctcggcacggtcgaaatcagtttttcagtagatgatggcatcgtgacccatgcacgcatctttggcgactttaatcaggccaatggtcacttgaaagtaatcgaggataagctgatcggaacgccttttaagaaagacaacctggaagaagccttcagaacgacaaatttatcagctaacattggccccatttcagcagctgaaatggccgacctaatgcttaatcctcattttcaggaggtgaactaacatgagtggtgaaatgctaggttcgctgtacaatcaaaatggttatttaacggctcgaatgcgaaatatctggtctgaccaaaatcgagtgaaagtcatttgccaagttgaaacggcggtggcttacgcaatggccaaaaacggcaagatccctgataaagcctaccaagaaatccaagccaaattggttccagaaaatattgatagggtgcagttaaaaattgagtcagccagagctggacactttctggcgggatttgtcacagtttgtcagtcactttttgatgacgacagcgggcaatacattcactatggagctgccagtgaggatgtcgaagacaccgcgtttgtccttcaacttaaggagtctgaccgggtgctgaaggattatcttgatcaacttggttcggtcctttatgacttgtgtgaacgatacaagagcactgtcactgccgccgtcgcccacaaaacatacgcctcccccaccacgctgggattcaagctcgggattgttttgaatgaattggactacctcatgcgcaagcttgattcactggcaccatttaccttcgctggcagcttagcgggtgccgacgggacgtcttcaatgctgggtgatgactatgatcagatcgaacaggatttttgtgatcgcttgggattatcaaaaccggaaatgtattggcacacgcagcgggaacgattcactgaatactgccatgtcgaaacgatgattgcccaggcactgggccgattaggcaagaatttactctatatgagtcagataattgttggtgaatttcaggaaacctatgcgcccggccgccaaggatcaactgttgtgcccaccgtacgaaacccatatatggtcgaagcggtcgtcaatttggcaacggtcattcgaaacgagatgggtctgatgtacgacacaatgtcagttgatggtgagaaggacaccaccgtgtggcgtgatttatatgttgccctccctgaaatgacaatgtacctttcaggccagttgaactacgccattaatattcttaaatttggccaatttaagcctcaacgcatgcggcaaaacttatccgctgacgatggcacaatgtactccggatcattgatgatggccctcgccaagcacatgggcagagaaaacgcccacggactactggtgaaactgcgtgaccaagctgatcgtgaacacgtcactttaagggacttgttttacgctgaccccaccattgccaagtatttaagttccgatgaccttgaccgactaatgaggtcggacggccaccttggcaatgccatttcaaaaacagaacagattctcaaattctataaagctcgtcactctaacgttaaaaatcgaaaggaagattaatatggcacaaaaaattgatgattcaaaatatctctggcaggcaacagttgatgattcacatactcgaattgggttaaatgacctggcgcggggtgaaattggtgaaatttccttcgctgcattcccaaagaacctcagtgcagttgcagaaggtgacgtcatcctctcatttgaaggggctaaagcagtcacggaagtccattcaccaaaggccggtaaagtggccaaaattaacactgctttgatcgatcatccggagtatttggatgacagcgaccaagacaaaaactggattgtggaactatattaatcctgacgctgagcattagatcgcaaaaaaggctgagacacaactaatcgtaagttatgtttcaacctttcttcagttccactggtatctagtttaaacgtgcaacgatcggctgatcccggccatttaagccaagaatcgagtcattccaagaacaggaacaactcgattcttggcttaaattctgggatcaaaacgcctcgcgttccactctcttttagtctgcttgaaggtttcctaatcatgttcatgtttcaaaatgccactgccaatcagcagcaactccatcgtggtcggaccgacgaacgtgaagccccgtttcttcatatccttggccagctcaactcccaagccatgggaatcttgctgcaatgatccgcgaaccacatcatcttttggctcgaacgaccacaaatagtctgccaaatctttaaattcaggctgcagttttaaggttgcttgagcattctgaacaacggcccgaatcttccgggggtttcgaatcatttctggatcggcttccaaagcttcgagatccatttcatcgaacttggcgatttcgtgaacgtcaaaatgcttgaagactttatcaaataccggaatcttgctggcagccacccgccaatttaatcctggctgaaaaacgttcactgtcagcatttcaaacaacacgcgtggatcgtgaatctcagtgccaaataatgaatgatagagatcaacgccatttaacggttttgccatcatcctcaccttcctcaaaacactatttgattatagactaacaccatccagcccatattcggcgttcaatgacggtttgattgctgttcgagtaattgtttgagcttttgcgaatccgcatcgaccacgggcttcatattcttgaaccgcttcgaatacgatggatgatacaaaggaaagatttgatgtttttccttagagagttcaaaggaatccgtctgctggttatatttttgaattgagcgttccaacaactggccatgtaaatcaccgattttggccttggtacctaataaccgctgaaggctggcattccccattggcaccaacaggacatcaggaaaatgggatagttcccagtcaaacatcgcagccgagcgcttaacttccttctgattggggcgccggtcactttttcgacccgttttcccaattgaaaatggacgggaattgaccactccggtaatgtagatatcctcacgggttaaccccagcgatgccagccaacgatccagttctttgccggatggtcccataaatgggcgaccaatcttgacctctttgtcaccaggggcttcacccaacaagagaattcgtggatgaaggccgccctcgctgggaacaaagccctccagccggggattctcggcggcaatcaatttggcttcatgaatccactctggggttaaaatggtatgcaatgtcatgttagaaccttctttcagttaattatttagaacgcctgatcattctttgtcggcgtggaaatcccagcctgtttaattaataaaatgaggccgaggcaaacagattagctctttgtctcagcctcattcatcgaataatgactatatgacttcattagtgaacaacaaccttagttccaaacggcaccgtttgatacatccatttagcatcagcgattgatagccgaacgcagccatgggatgcgggagtgcctaacttctcagcttcagaaaccacgtactgaccgtgggcgttggtcggcacactgtggaataagtagacgccgtgatccaaccaggaaacccagtagtgggcgccttcgtgtgagcgcttgttataaaatgaatagccgcgttccttttggatatggaacgttccccgtggcgttgggctgctggggatgccagttgaacagttcataatgtattgaaccttgccattaccatggatgaagactttctgttgtttgacactcacataaatccaaggcttgctcattttggaccattctggataagctttgttttcagacggcgctttccaatagacactttgaatggtggtctgactatcacttggcgttgttgccttccgaactgcaaatgaatgttgagcagcggccaaggccatgacgatgaatactgaaacaatgataaatgcaaagacatttttaaatttcactatgtaactcccccaaaccaactactcccatcttacaacaaaatcaaccagatgtttgccagcatgctcgtaggtactgatagctggcacgcatttcttgactgttcatttggtctttgagattgatttcaaaaatatcggtggcgtccggattgacgaccgattttaaaggctgccaatcaatcgcgccctttcccagttccaagctgtcgtggaactggcccattgaatccacaaaatgataatggacaacctgatctcgcaaatgcgccatactggccttgagtttcgaattattgccgtgcagcacaatgaacccatgactggtatcgtagcacagccggtattgatgctcaatgatcaggttttcaatttctggatcgccgtaatcaaacagcggtgaaatggaattttcaaacatcacatggtccccgcccagtgatttaaaatggtccaagcgattgaacaccaccttgcgggcggaatcaatcgaagggtagttgctgagaatatctgaaaccggtgagttgtaggccccgtgaatcaaaacttgcgtgttagtctgaatggccagctgaatcaaattttcagaactctgcattaaaaagtggtaagcgtccggattactcaatcggtcaactgccacttcattgtgttggccgttaaacttcatcgggtggtgcatgacaattctgtcgaccccagcggccttcacgtgttcaatcatcgccttcaaatggttcaggccacttggcgtcacatcctgatcggtggtgaagaattcaaatacttcaggatgatattttaatcgttcatcaatttgggcttggttggtactggctttgagacccaagtaaggaaacatactgccacctctttcacaatcatttaattagttttattatatcgccacccaattattttgtgagactgataaaatttcttaaacaatttatcaccttattgacgaccactgtgctacatttaaagcataatacatactactaaatcgattctgggggcaaaacaaatgaaaaagttgaagagtcggctggacgcttttagcgacgcggtgatcgccattattttgacaattatggttttggatctaacaccagtcttgcgggacaacttgaatgattacttgtttttaagcaaacaaattggcatctatattatcagcttcgcttttgtggccaacatgtggtatcagcatgccaccttgttcaatgacattgatgatatgagttatcgaatcatgttgtatgattttatcttcttaatcccactatcactgacaccactggccactaacatgatggccagcaacaccacccggattccggtcatggcatacggtctcctgttatttttggtttcagcatcatttcgcctgctggcacgatcagtcatgcactttgagtacactgacaaatcaaaaatgcgccagctgtatcgaaaaatctatgggcgtcacaatcaatactatttaattttcaacgccgtcttgattgtcctggcctattttttcccacaggttgtcttgtggttctaccttccctatccaatcgtctatatgatcctaagcagccgcgatcgtcaacaaatgtacgatgcttcgcaattgaccaccgagcagcgacaggaatacttgaagctgccgcagaacgccattaatcaatttagagaaatggtccaggaccaggcagcaaccggaactgacagaacaacgtcaaacgcgagtcatcctcaacacgggtttagcggttggcttgatcacccggtcgccaccgacagtgccggccattcggtcaacccacacgctcccagcaataatccagacagcgtcgaagtcagaaaagagcgccaggcacagtgggaagaatttgccaagcaaatccgtgatggttccaagaaatatcgtgacgcagctgaacaaattcgtaaagaacagcgtgataccaatcgagaagccgtcaagcaagcagcacgacaagccgaacagcagcaagatcaacgcaagcatgacgccgaagctgctgccaaggaagccgaaattcagcgtgaagcccgtgaaaaagcctcaaaacaagccgctaaggagaccgaacgccaacaggaagctgataaggaatcagccaagcaggctgccaaagatattgaacgccaagcaaaggccaagcgccgggctgctcacgaagaagataaaattcttgagcatcaaaaacgcacccaacggcgagcagaacgccgggatgccaagcacgaagtcaagcaaaagaagctgcaggctaaggctcaagcctatgagccggatcaaaattccaaacccactgaccatgacactgaacagtccgatcaggaaaagcatgaagagtagcacagcatccccaggctaaaagattccccaccagccaatttgatttgagattaacctcctcaaaaacttgtgaataaccaagcagcgattccttaaccaccaagcggaatcgctgctttttaaattaattttgcagtgccaagccgcaaatgtataatggcattaattacattcaggaggtcacttaatgaaaattaaccaattcgggtatgtccccaccaaccatcaacaaataatcaatgaactgacagaaattcattttttgaatccgaccaatcttaagataagcgatccgatggaactctatcgcgattttttgctggaatactactcccagcacgcttccctaaccactcgactggaaaagattcataacttaatggcaacagaaacgattgatgcagcaacatttaccaaggcaactggttccgtgtccgctaaagccttctataatattggcctgcaattactgggattcttagacggattggatttttccctcgaagctccgttcaagggcatcacgcaactgggcctgccgaaaccgttgaaccagtcaacgatgaaccgtgatcagctgatcgatgcttggtatcggttgttgaatacccggaacaaatacggtcaactcctgatcgactacatagctggcaaagggtattaccagcagttgctcaacgattccgatttcaaaataccactattcttcaacggcaaagcccaagccgttttcaatacagataaattaatccgcgaagtcgtctacgtcgaatcatccctggactcggaccacgacggtaaacgggatctgctaaaaaccaatatcatccggcctgctgaaaccaacgagggctaccaagcgccggttatcttcactgccgacccatacgcccaaggcatgaacgaaaaatggtcagagaagttctcccacgacaacaagcgtccactcaagcgaaaacaaccgaatcacctaacctatcaagatgttgaagcacaacccagcaacgtcaccccacccaagccgcgaaaaattaacggccgaacgactaaaactggtgaaacctttaccaagttttggtcgtattctctcaatgattattttttggcgcgaggtttcacgatcgtttactcatcagggatcggaaccaaggactctgacgggttccggaccactggtaccaaggctgagaccctaagcgcaacggcggtcattgaatggctcaacggcaaccggactgcctttaccaatcgctccgatcaaattgcgatcgatgcttggtggagcagcggcagtgttgggatgactggccgctcttatttaggaacacttgccaccgcagccgcgtttactggcgttgacggcttaaaaaccagcatcgtggaggccggcttatccgattactacccttattatcgggaaaacggcctggtggttgccccagatggcgatgatgccgacgttttagccgaatggactttcagccgccaacagaccgctggggattatgtccaaatcaaggatgcttggctgaagcattttaaacagatgactcacgaccaagaacacgataccggcagcttcaatcagttttgggacgcccgaaacattaccaaatataaccataccaaggcggatatgctactggttcacggtttgaatgattggaacgtcaagaccggtcaagtctggaattcccggaataagttaaagacccgagatatcacgcaaaaattgatccttcaccaaggccagcacgagtatctcaacaattttcgctcctttgattacaccgatctggtgaacctgtggctgtccaacaaactatttgggattcaaaatcgggtcgacgacgtgatgccagatgtaatcgttcaggacaacgcccacgcagaaacgtggcataactatcctgactggggcggatctgaatcaactaagcgcactttctcgctcgccagtttgaataacatcaaaggcaatttcagtttctcagatcagctgccaaaccaggttttcaagcattacacccagcacctcaatgactggcgcaatgatttatattcacgccaaggcaccgccatggacaaccactgcattcggctcttgtccgacccactgacacacgatatcacaattgatggccaaccaacgatctcgttagttgcccaaaccagttccattgtcggccaaatcagcgttgcccttgtcgactacggtgaggatcagcgattaactgaagtccctcaaacgctggtttcccaaaagattttgcaaggttaccattggcgaaaggatgacttaaaagaatttcttcctcagacgaacccaaccgactttaaacgaatcaccgaagctcacatcaacatgcagaaccgccaaaattcttatcgcgtcgatgatgtgcagccacaaaccggttataagttgcgctttgccttccagccaaccttttggcacttactcaaaggccatcaattggggttggtaatctatgccagtgacctggtctacaccgtccacggtaatcaagccatcacttacacattgaacttaaacgattcaacgctggaagtgccagttttaaaatcgtgattagatcaatgaatttgtaaaataacgactccgtccaaatcaaaaagcttcgatgccaactactgacaccgaagcttttaatacggccttatttcacaatcttcacaaaatgtccattagcggtgacatatccaccactgacaagatatcgtttggcaccaaaggtcgttgttgaatattgatgggagtaatcccacttcttcactttcaaaacagttcctgccttgatgtgtttcaatcgtttattcaagttcacgttgttgtacaagtaaatcgaccgtttaaccttaatcttggttggttgaaccagtttgccggcaaataccagcttccggttaccggtaatatagtgtccattactcagcaggtatcgggtagtcaggttatgtttgacaaatcccttcactttgagttgagtgccctgcttgaagttcttaatcttaccagtcaaatttcggttggtatattcattgacgccggttgggttaatgactgtcagaacttggtgcttgctgtggtaatacactgggcggacgtatgcataccgagcggtaatataccccttcatcccatcagatttggcgtggtgattcacatctttcaccacgtaccgcagggcgccgttctttgatttggcataatcgctcacgacaaacatcggccgatttacccgcggctttttggcatagctggcaattcgttcgcctttcttgaaatcagcgtgccgatacaggtaaatcttcttcagtgaatagaccgcttcacctttcttggcaatcttgccggcttcatttggtgccgtcaccgtctcctgtgaagtcggttctgacttcggctgaggagttggttgtggcgtcggctgtggtgtcggtgttggggttaccggcgttactggtgggttaaccggcggcgtcactggggtggccttatctttggtgtaacgataatagaccgtgtggccagtggcatcaaaggtcccggtagcatccccttggatatctttaaaggtataaccattaatgctgagtttatatattgtcacggacatcatatttgtcaccaatgatgccggctacagttctggttggcgcaatttcatgaggcatgttgtccgcatcaacgtaacgaatcataatcggtttagcctcatttttcgcttgatcccgtttataacgatagtagaccgtctgcccctgttcactgatttgacccgtcgcatttccttggatatccacaaaggtatacccatcgattgcaagtttgtactgagcttcagtggtgttgtagttgtcaccgatttttccggtaatcactttttcaggaccaatctcgtgaggcaggttgtcaatatcgacgtaccgaatggtcactgattttggctggacaggattcttggtgtactgcatgtaaatcgtttgcgcatcgtcaccaaattttcctgtcgcatcgcccaaaatacctgcgaatgtatagcctggaatggtcaacttgtaatcatcactgttcacattaaaggtgtcatcccgtttgccggtcaaaaccttttgtggcccgatctcatgaggcatattgtccttgtcaacgtaccgaacggtgactggtttggcttcggttggcttgacttcatacacgtaggtcagtgacatgtccataaaatcaaatttcgctggtactgtttggccttccttgagccccttcaaagtgtatacctgatcatctttggtgattgttgaaggaattgtcggtaaggtaaaatcagtattggtcttgccggtaaccgccgttgaatcttggagcttgttgccgtcttggtcctcgtagttgattgtgacggttgatgaatccgatgcaaacacaatcgtccgggtctgaggaagatcggtgtacgttccggactggccaaccgcgttggctttaccgttattggctttgaaatcggcatataagccggtgccatcaaacacgccaattgccacccgtttgtcttctcccattaatttattcagggtgtaagccgtgttaggattattgccaatattataggcatcccccacatttccggccattgtgctggttggggccaactggagttgatttccattggactgcagcagctgatagttcacaaagacattcccgaccgtttggttaaactgataaggtaccataatccagccttcaaaatcagagttgggatcggtccagtgactggacaacgaaccatacaagttggttttgtctggtaagaagtttgtccacgtcaaagtggttggattgatgttgccgccatcagaggtgcttgggtacaaacttgggtaatcagacttttcacttttgatgtcaaacgccttgaccggtaaattggcggattccagatccttgatgataaaggacggagtcgtaaacgacgtttgagcagccgtagcggcactgccccgcaaagtaaccggttccaaaagaatgtgctggtgattgaaccctgtcttcaaattcagtcctttattgcctttgttagttgccagaggtgacaagtcggcaatttgattgtaagtcaacgaaaggttggttaaattaggtttattggccagagcggagacgtcgttaattgaaaacatttggatcatcaccgactgtaattgattcaaatttttcagcgcgctgatatcccacaaatttccatttttggtacctgtcccaaacgctgccgcactgacagccgcgttgggatccagattaatctgtttgagattcgttgcatattgcagtccctcaagagaattcattcccattaaagccatataatactgggatggttttggatttgagtcggtcccggcattttgtgggcccatttcgctataaagtgactcaagatccttcaaatcattttttgaaaagttggcaaaaaagctttccgccgttttgtacttgtccgcaaaggctgcctgccaaatgaaatactcaagtccaggatccggcatccattcactgacgtacgagttgccggtcttcggatcagttcccttggcgtcgttaggaattgcggcggcataagctgccccctgccaccctcccaagtgactgagactctcatggacgtatgtgtattgcagtggattcactttactaatattgaattcatcggtccgcgggataacgttggtcacatcatcggcagaagcgtgcatgaatcccaatccgcacgcgactgcgattgtggtaaccatccccgttaggatcttccatatccgtctgtgttttgttcgaaacttcaaatttgatgagttgctaattcggctatccatcataaacactccctcataatttgatattcatactttccccactccacccacatagtaccactttgttcctacttttagtactaatttgtttaatatattattacataacgattatgttaggggaagtcgatcagttaagtacaaagcgcttacaattgtgtgcaaatcggttgtaatgagaattttacccatcaaaaaagtcctgagcagcggatgccaggactttttctggaaaataatttagtgatttccttgaataattaatttcttgttggcggtgatgtagtcaccattggtaagttgataacgagtcgttaaatgatatttgacaatcttcttgacccgcagatggctaccgttcttataagtctttgtcttcccggtcaggttgacgttcttataggcatgaacgcctttcttcgagatcaccgtgagctgatttttctttggcatggtctggtagtatacgttgacaacgtacttggtgttagccgtaatgtagccgatcttaccatcagatttcttggtatggttaacatcccgaaccttatatcttaaggcacctttgcttgagcaatcatatcctgtgaccacaaacatcggtcgatcaacacgttgtgctttgtgatatttaaccaagcggtccgctttcttgaaattaacgcccttgtgcagataaattgtcttcttggcgtacacagcagcgcctttcttagcgacccctggtgaaacctgaatttctggttgcgaattgttggcaggctgctggtttgttgatgtctgggtattgccaccgctagctttggagttatccgtaactggtcgtcccggaaccttcactgtgctgcttgtcgaacctgtatttctggcaggtggtgtcaccacactggcccgtttgccaatggttactttgacagtttgagaagcgccaccattggtgtaagtgatggtataggttttctctgcagcgttggtgtcaaccttgtcgacatccttgccggctgcgtctttgatattggtaatcttcacgttacctggcgatttaaccttattgccgttagcgtcggtcaaactcttaattccattaaacttctgagtgtcccagttgctgccatgagagatggtaaagtcgccagcctcgatggttgattgatctttgacagtggccttcactttcttggtaaccccatcgtaagtgtaggcaacatcgtaaatgcctttttgatcagttggggtgatcttggcgtcggctttggtcttgtccggctgttccttaccatcagcatcaaacatatgattgatcccttcgaatttatccgcgttggttaacgttgcgtaggtttcggattcgaagtcggcaacgtcgagagtccgagtaatttggagtgtaatttcattttttaccaccttatccacgctggtattgtccgtatagaattgcatttcacttctaaatcgagcgatacgtgatggattaaaatcaaaatccggtgccagtttcaatggaactgtcatctcaactcttgcatttgcagccatctgaattggccaaacactacttgtgtcagtcattccaccataaaaaatacttgttaagtcttctgatggtgtatattgtaaaacgtatctgctgtcttgagaatatgaccatgattccatcattggttctttgagatcgctggcaaacccaattgacttcatttccgggttccctcggcttgggtcaaaaactaaggattttgggttattggcggtgtgatcaaacaaccacggaagatggacaaaattccaaaccggcaacgaatatcccaagtcatttgtaactgaataccgcgcatatatgtttgaatatttatcgacattcagcaagtcatgagtagttgttggatcggcaacactttggattgaagcaatcgtctgctgcttcccattagcgtcatcaccagttatcgcaagtgtcggtcgcaaaatatcctttgaaggtgttgcagcactggccgtggacgttgttgaaaatccaaggcctgttaaaactgcaaagaatgctaccacggccacacacgcctgttgaaaccgtgtaataaatgaactcttccctaaaacacgcataagtatcactcctatatgaattccattcccgtttaatttacaaaataatattatcacactatcctaaaaaaacataactaatttgatttgatattgataacaatatgttaatgacattgcaggtcaataattgaatatacctacaaattaaaaagaacaataaccaaccatttatttcataactaaactaccctctccgactaaagagctgtaaaataagctcatacactaatctagggggatggtcggggtgtttcactattcaaaatcacgcttaattggtatttcggacgagatctttgctgtggttctaaccattatggtgttggacatcaaaacaccaatcagtacagcgcagggaccaatgctggatctgatcaaacatttggtgatttattttgttagttttgggattgtttctcagtattgggtctatcaccaggaactatttagtcgcatcgaacatacaacgtctttgattacaatcaccaacatttattacctttgcttcatcagtttgacgccgtttgcgacctcttggttaaatgacgattttggccaccagctgccgacaatggcttattcagtcatcattattttggtgaacctgacccaggcaatcatgttccacgaagttattgaaatcggtgaatcagatgggatcaaaatgtcggctcatgaccgcgaagaatacagatcggctcagatcatgctcggattcagtctgctatacctgctgatttcttactttgcaccgcagtacttcctaattgtggtgatcatcgggattgcgctgcggacaacggttaccacgagtgcccgaatcattaatttcatccggactcgaagaatcacgaaataattcattttttcttgaacgccctccggcataatttgctataatgaatttacaaacacttaagaaattcttaataatttcgatccgtattggggggatatagatgaaatcaagcagtcaattgttatcaatcatcgctttgacgttgggactggtttcggctgccgtatttggcagcaacgctaaagccgccaaaactatgacggttaattacgtttcaacatcggggcaaactttgcgggcacccattacgtatacccgcatttcaaatggtattaatgcgtttggtaccacctacacgtatacgaccagcggttatccggccactaagtccggctatgtcaaaacaatcaagggctatttaccccacaagattcagcagaattacacctatgccagcatgccaagctcgctaaccgtgaagtacataaaggaatcaacattggctcgcaaggttgacacacagtacatgaaacaaattaatgcttatcgattgacgaaaggactcaaggcttttaagcatcgatcttcactgaaagctaaaactgttgtccgttccaaagaactgtggaccaagctaagtcacgttcgtccaaatggccagtcctataatgcctcggggagtggctacgcagagtgtatggccgttttgccgacttatttcacgccatatggcatcacgacttacaattccggccaaggggcaattctggtgtacaactccaatggttatgtatcgtataaaaagactgcccaaacagccagccatgaactgctgacctgcgacgccgaacaccgagacaccgagttaaataattgggcaacttacagtgaagttgccttcagcttccacgctgatgggtccgccaaaatggctcagctgtttgaattagctggtgcgaaagaataaataataatgtccaaatcaaagtgccccaaataccattttacgatgatagatgatatttggggcactttttcttagcgttcaacttatgtcatgacggcaagcactcgactgtcacgccgactcacaagctaatttagtatgattataaattaataatcattatcagtgacattgtatttgcaatcctctacaatcaataatagaaaacgaaaatgggggaatcaaaaatggcagaggcaatttttgacatacaaaacgttggcttaacagtctcacaacgaacgctattggctaatatttcttttaaggtggcaccgggagaatttgtgaccattaccggtccttccgggtcaggtaagagcaccttactgttattattagccaccttgctcacacccacagaaggccaaattatattttcgggtcagccacaacaagaatatgaaacgacggcgtaccgtcgcatggtatcttattgctatcagcaacccagtctttttggtgagacagttgaagacaatctggcctttcctttccaaattcgccaaaagccggtcaatcacgatcggatggtaaaagctttggcagatgtgaatctccctgccgatatgctgacaaagaacattacggaactttctggtggtgaaaagcagcgtgtcgcgttgattcgcaatctcatcttcacgccaaaggtgctgttattagatgaaattacaactgggctggatgcggcaacaaaggacactgtccatcaagtgatggccaactttaccaaacaaggcgtcacgattatcactgtcacgcacgatgagtctgaattggcggcagccgatcggcttatcaccattgttgacggcagaatggaggtgacagcatgaatcacctgattgttaccccgaccgctttattttttgcagttgccttagtggctgtcgcattttttatcagcctcaaagaaaaaattggtcttgaaaaagacttggtaatcggcgtcatccgtgccgttattcaactgacaattgtcggttacgtcctgacctatatcatctcagttaaccgagcttggctgacacttctcatggtagcgatcattgtcttcaacgcagcttggaatgcaagaggccgtgccaaaggcattccccatgcttttgtgatcagtctgcttgccattgccgttgccacgggggttacaattggcttgctggttttggcgaaagcgattgcctttgttcccagtcaaatcgtgccggtttccggtatgattgccagcaatgcgatggttgcgattggtttggcctaccgaagcttgaacagccagttccatgatcagcgccaagggttgttggaaaggttggctttgggagcgacgcgttaccaaaccgccattacggtcgtacgagaagcaattcggactgggatgagtcccacgattgattcggcaaaaaccgtggggattgtcagcctccccggtatgatgtctggtctgatctttgctggtgttgaccctacgaaggcgattatgtaccagatcatggtcacctttatgctcatggcggccactagtattggcagtacgatatcgtgttatttggcgtatccacaattttttaataccaatatgcagttgaggacgccgcactcgtaaatgtttccggaaccggtcattcaactaaacaaggcacccatttcaaggtcagaaatgggtgccttgtttagttagattgcggtatcaaatcgactttcaccacaattttatttttcaatggcatcaataattcgctgttcatcatataaattcaacaccagatacatcccgatataaatcaccagtggaatccaaacatagttccaattaatcatcgacaaagtcgccgcattctgtgactgattggcaacgtaacccgacacgtgaaacaagccggccgtaatcaagccgccaattcccagaccaaagttaacgccaaaatcatccgttgaagctaaaataccttctgcctgaatccccatgctggcaccgtatcggatagtgtcggcaatcataattgagaccagaccgatgataatgccgtttccaattgagttaataaagacaccggcaaacaaaaccagcagccatttaccatacacgccggcagcaataatcgcctgcgcggttaacgcaatcaagatcccatgtaacattgttttcttcttactttggtgatcggtcagtctaataatcattaacacgccaattaaagcggccaaggtaaagccatttgcccaaggaaccagtccttcattgccaagggtgtacttgaagtaataaatggtcgtctgattcttaatcgccgtgaccagccaatacatagagatcacaatcgacatgataatccacggctggttgtgagctaacatgttcaaaacaaccttgaccggttggtgggcaatgtgtggattggagaagcgttcacgcacgtgcacgaaggtgttgagaatcaaaaaaagtgaaatgattccaaacacgataatcgttcccagaaatcccttctgctggttgccgtggccgaatagccaaaccaaaggcagtgtgaaaactgccacgatgatttgtactgaactgccaaagaactggcggataaccccaagcagtgtcagctcacgagtattctgtgacatcgttggcagaattgatgtaattggcagattaacggcggtgtataagaatcccagaccaagataggtcacgtaagcccaaatcagtttgccgccataggagaaattcggtgtgacaaacgtcagaatcgcaaaggccgcgtaaggcaccgaataccacagaaagaacggccgactcttaccaaatcttgaatgggtgtggtcaatcatgataccgatgataaaactttcgacgacatcagctactcgggcgaccacaaacaagatggcgaccgcactgggtgtcaaaccatagacatcggtgtaaaaaaacagcaaataagtcgtcatcatttgaaaaatcagattgtcagccgcatcacttaatccatagctgatccgttcagtccacctggttgaccattcagcactcgacttcaagattgccaccaccttttgttaggaattaaaacatctaaactaattgtacgcaacttcgcttttaccaacaatcaaatgcacgttaaaaatttgaatgaagacaaaaagaaagccctgctcgcatacaggactttctaagggaattttatatttcatattgaggggtaattcttattcaattcatattgaggggtatttcatgaagttaagaatcttgtcaatcttgttgggtatttcttagtaattatttgaggggtgaatattatattgtgatacgctagtaaatccgattattctccatggcatcagtcctttcaatgggttagtgagttccagcgctcggtcttgaattaactcggtacttggttttagtagcagctccagaccacaaatctttgatgctggttggaaccgtatgcgtatttaaacttgggttttaaaagggtcttttttgacatgtacagttcatccttcctttcgcatagacagtcatctgggagctgattagaaatcatattaggggtttggtttgatgtgcttgcttggtgtttccctcctctcttatttgattgtctatagattacctcagccaacttaaacgaagcttaaatggctaaaatttatttgatttttttattcaactgataaaccgccagtgtaatgagttgattggctggtgtagacacgcagggtgtaagtacctttaggagcgctgaatgacccggttgcggtaccagaagatgcgttaatcgtcttgtaaaggctgccgtctttgtaaatcttaatttggaacggcttggagctggctgaaccgtcagattcgtaggtgttaattgagtatttgacagtcacatttttattagcgcgcttattttgaacagttggtttaaacccggcattttcactcttataagctgaaccggttagccttggggctcgttgatcaaatgtggtcgtagcggctgtactattcgttgtcttagctggggtcgtagttttggcaggagttgaattattcgcctgctgattgctgctcgaatttgacttggctggcgtagtggtttggtttccggttttggctggtgtggtttgcgttttggttggcgttgtcgttgcagctttattctgatccgtcttgctctgatccgtcttcttagcagcttgatcagtgttactcttggactggttgttcgattgggtcttattgccattagctgtttggctgttggtatttgttttattagcttgttgagattgtggggttggggtaacggcagcgttggcagttg
